(12) United States Patent
Omura et al.

(10) Patent No.: US 7,630,836 B2
(45) Date of Patent: Dec. 8, 2009

(54) POLYNUCLEOTIDES

(75) Inventors: Satoshi Omura, Tokyo (JP); Haruo Ikeda, Kawasaki (JP); Jun Ishikawa, Sagamihara (JP); Hiroshi Horikawa, Tokyo (JP); Tadayoshi Shiba, Musashino (JP); Yoshiyuki Sakaki, Yokohama (JP); Masahira Hattori, Fuchu (JP)

(73) Assignees: The Kitasato Institute, Tokyo (JP); National Institute of Technology and Evaluation, Tokyo (JP)

( * ) Notice: Subject to any disclaimer, the term of this patent is extended or adjusted under 35 U.S.C. 154(b) by 60 days.

(21) Appl. No.: 10/156,761

(22) Filed: May 29, 2002

(65) Prior Publication Data

US 2003/0119018 A1    Jun. 26, 2003

(30) Foreign Application Priority Data

May 30, 2001 (JP) ............................. 2001-204089
Aug. 2, 2001 (JP) .......................... P.2001-272697

(51) Int. Cl.
*G01N 33/48* (2006.01)
(52) U.S. Cl. ....................................................... 702/19
(58) Field of Classification Search ..................... 435/6, 435/91.1, 486, 252.35; 536/24.3, 25.3, 23.1; 702/19, 20; 703/11; 424/93.43
See application file for complete search history.

(56) References Cited

U.S. PATENT DOCUMENTS 5,795,714 A * 8/1998 Cantor et al. .................. 435/6
6,251,636 B1 * 6/2001 Betlach et al. ................ 435/76

FOREIGN PATENT DOCUMENTS

| EP | 0 997 528 A1 | 5/2000 |
| WO | WO 99/41389 | 8/1999 |
| WO | WO 01/09155 A1 | 2/2001 |

OTHER PUBLICATIONS

Aparicio et al., "The Biosynthetic Gene Cluster for the 26-Membered Ring Polyene Macrolide Pimaricin", Apr. 1999, The Journal of Biological Chemistry, vol. 274, No. 15, pp. 10133-10139.*
GenBank Accession No. AJ132222 (GI:4678702), "*Streptomyces natalensis* pimS1 gene", Apr. 24, 1999, [online] [retrieved on Aug.

27, 2004]. <URL:http://www.ncbi.nlm.nih.gov/entrez/viewer.fcgi?db=nucleotide&val=4678702>.*
"*S. griseus* afsA gene encoding a possible A-factor biosynthesis protein", EMBL, Database accession No. SGAFSAA, Jul. 6, 1989.
"*Streptomyces fradiae* tylosin-biosynthetic regulatory gene cluster", EMBL, Database accession No. AF145049, Jun. 30, 1999.
"Gamma-butyrolactone receptor protein TyIP from *Streptomyces fradiae*", UNIPROT, Database accession No. Q9XCC7, Nov. 1, 1999.
"*S. coelicolor* putative sodium-coupled permease", UNIPROT, Database accession No. Q9KZY9, Oct. 1, 2000.
"Polypeptide involved in the biosynthesis of streptogramins", EMBL, Database accession No. AR124150, May 20, 2001.
"*Streptomyces pristinaespiralis* autoregulator receptor protein", UNIPROT, Database accession No. Q8VVP1, Mar. 1, 2002.
NCBI, Accession No. NP 821594, Apr. 13, 2006.
NCBI, Accession No. AJ 132221, Apr. 15, 2005.
NCBI, Accession No. AJ 132222, Apr. 15, 2005.
Kunst et al, "The complete genome sequence of the Gram-positive bacterium *Bacillus subtilis*", Nature, 390, 249-256 (1997).
Wang et al, "Large-Scale Identification, Mapping, and Genotyping of Single-Nucleotide Polymorphisms in the Human Genome", Science, 280, 1077-1082 (1998).
DeRisi et al, "Exploring the Metabolic and Genetic Control of Gene Expression on a Genomic Scale", Science, 278, 680-686 (1997).
Wilson et al, "Exploring drug-induced alternations in gene expression in *Mycobacterium tuberculosis* by microarray hybridization", Proc. Natl. Acad. Sci. USA, 96, 12833-12838 (1999).
Behr et al, "Comparative Genomics of BCG Vaccines by Whole-Genome DNA Microarray", Science, 284, 1520-1523 (1999).
Lockhart et al, "Expression monitoring by hybridization to high-density oligonucleotide arrays", Nature Biotechnology, 14, 1675-1680 (1996).
Ikeda et al, "Organization of the biosynthetic gene cluster for the polyketide anthelmintic macrolide avermectin in *Streptomyces avermitilis*", Proc. Natl. Acad. Sci. USA, 96, 9509-9514 (1999).
Omura, Satoshi et al, Structure prediction of secondary metabolites of *S. avermitilis* by genome analysis, Database accession No. 139:346383 CA XP-002266244 (2001).
Omura Satoshi et al, Genome sequence of an industrial microorganism *Streptomyces* . . . metabolites, PNAS, Oct. 9, 2001, vol. 98, No. 21, 12215-12220.

* cited by examiner

*Primary Examiner*—Jerry Lin
(74) *Attorney, Agent, or Firm*—Nixon & Vanderhye P.C.

(57) ABSTRACT

Novel polynucleotides derived from microorganisms belonging to actinomycetes and fragments thereof, polypeptides encoded by the polynucleotides and fragments thereof, polynucleotide arrays comprising the polynucleotides and fragments thereof, recording media in which the nucleotide sequences of the polynucleotide and fragments thereof have been recorded which are readable in a computer, and use of them.

7 Claims, 4 Drawing Sheets

POLYNUCLEOTIDES

The contents of the attached CD-R compact discs are incorporated herein be reference in the entirety. The attached discs contain an identical copy of the files listed in the following table which were created on the discs on the dates shown in the following table and have the file sizes shown in the following table:

| Name | Size | Type | Modified |
|---|---|---|---|
| seq1(1).doc | 18,273KB | Microsoft Word Doc... | 5/24/02 2:59 PM |
| seq2(2-2000).doc | 21,677KB | Microsoft Word Doc... | 5/24/02 3:03 PM |
| seq3(2001-3500).doc | 10,360KB | Microsoft Word Doc... | 5/24/02 3:30 PM |
| seq4(3501-5500).doc | 21,173KB | Microsoft Word Doc... | 5/24/02 3:28 PM |
| seq5(5501-7551).doc | 21,627KB | Microsoft Word Doc... | 5/24/02 3:25 PM |
| seq6(7552-10000).doc | 18,036KB | Microsoft Word Doc... | 5/24/02 3:21 PM |
| seq7(10001-12500).doc | 18,704KB | Microsoft Word Doc... | 5/24/02 3:16 PM |
| seq8(12501-15101).doc | 18,683KB | Microsoft Word Doc... | 5/24/02 3:12 PM |
| seq9(15102-15109).doc | 821KB | Microsoft Word Doc... | 5/24/02 3:08 PM |
| seq1(1).txt | 11,616KB | Text Document | 5/29/02 10:21 AM |
| seq2(2-2000).txt | 8,852KB | Text Document | 5/29/02 11:21 AM |
| seq3(2001-3500).txt | 7,207KB | Text Document | 5/29/02 11:22 AM |
| seq4(3501-5500).txt | 8,653KB | Text Document | 5/29/02 11:22 AM |
| seq5(5501-7551).txt | 8,884KB | Text Document | 5/29/02 11:26 AM |
| seq6(7552-10000).txt | 7,158KB | Text Document | 5/29/02 11:27 AM |
| seq7(10001-12500).txt | 7,329KB | Text Document | 5/29/02 11:28 AM |
| seq8(12501-15101).txt | 7,437KB | Text Document | 5/29/02 11:29 AM |
| seq9(15102-15109).txt | 288KB | Text Document | 5/29/02 11:29 AM |

BACKGROUND OF THE INVENTION

1. Field of the Invention

The present invention relates to novel polynucleotides derived from microorganisms belonging to actinomycetes (actinobacteria) and fragments thereof, polypeptides encoded by the polynucleotides and fragments thereof, polynucleotide arrays comprising the polynucleotides and fragments thereof, computer readable recording media in which the nucleotide sequences of the polynucleotide and fragments thereof have been recorded, and use of them as well as a method of using the polynucleotide and/or polypeptide sequence information to make comparisons.

2. Brief Description of the Background Art

Actinomycetes are used in producing various biological active substances comprising an antibiotic which is obtained from a precursor such as amino acid, nucleic acid, vitamin, saccharide, organic acid, analogues thereof and the like, and are very useful microorganisms industrially. Many mutants thereof are known.

For example, *Streptomyces avermitilies* is a Gram-positive bacterium identified as an avermectin-producing bacterium having parasiticidal activity and insecticidal activity, and avermectin is produced by mutants thereof. The avermectin is used as a parasiticide of livestock worldwide, and is used as an agent for treating and preventing human onchocerciasis in countries of tropical regions where the onchocerciasis is prevalent. The production of avermectin using *Streptomyces avermitilis* is carried out in a mutant (metabolic mutant) of which metabolic pathway and its regulation mechanism are changed. However, accumulation of basic genetic, biochemical and molecular biological data on actinomycetes is insufficient in comparison with *Escherichia coli, Bacillus subtilis*, and the like. Also, few findings have been obtained on mutated genes in biological active substance-producing mutants. Thus, there are various mechanisms, which are still unknown, of regulating the growth and metabolism of these microorganisms.

A chromosomal map by crossing of *Streptomyces avermitilis* ATCC 31267 is reported and it is known that its genome size is about 8,000 kb (*Mol. Gen. Genet.*, 252: 255-265 (1996)). Calculating on the basis of the usual gene density of bacteria, it is presumed that about 8,000 genes are present in this genome of about 8,000 kb. However, only about several ten genes mainly concerning avermectin biosynthetic genes are known in *Streptomyces avermitilis*, and the nucleotide sequences of most genes have not been clarified hitherto.

In recent years, the full nucleotide sequence of the genomes of several microorganisms, such as *Escherichia coli, Mycobacterium tuberculosis*, yeast, and the like, have been determined (*Science*, 277: 1453-62 (1997); *Nature*, 393: 537-544 (1998); *Nature*, 387: 5-105 (1997)). Based on the thus determined full nucleotide sequences, assumption of gene regions and prediction of their function by comparison with the nucleotide sequences of known genes have been carried out. Thus, the functions of a great number of genes have been presumed, without genetic, biochemical or molecular biological experiments.

In recent years, moreover, techniques for monitoring expression levels of a great number of genes simultaneously or detecting mutations, using DNA chips, DNA arrays or the like in which a partial nucleic acid fragment of a gene or a partial nucleic acid fragment in genome DNA other than a gene is fixed to a solid support, have been developed. The techniques contribute to the analysis of microorganisms, such as yeasts, *Mycobacterium tuberculosis, Mycobacterium bovis* used in BCG vaccines, and the like (*Science*, 278: 680-686 (1997); *Proc. Natl. Acad. Sci. USA*, 96; 12833-38 (1999); *Science*, 284: 1520-23 (1999)).

SUMMARY OF THE INVENTION

An object of the present invention is to provide a polynucleotide and a polypeptide derived from a microorganism of actinomycetes which are industrially useful, sequence information of the polynucleotide and the polypeptide, a method for analyzing the microorganism, an apparatus and a system for use in the analysis, and a method for breeding the microorganism.

The present invention provides a polynucleotide and an oligonucleotide derived from a microorganism belonging to actinomycetes, oligonucleotide arrays to which the polynucleotides and the oligonucleotides are fixed, a polypeptide encoded by the polynucleotide, an antibody which recognizes the polypeptide, polypeptide arrays to which the polypeptides or the antibodies are fixed, a computer readable recording medium in which the nucleotide sequences of the polynucleotide and the oligonucleotide and the amino acid sequence of the polypeptide have been recorded, and a system based on the computer using the recording medium as well as a method of using the polynucleotide and/or polypeptide sequence information to make comparisons.

DETAILED DESCRIPTION OF THE INVENTION

Figure 1:
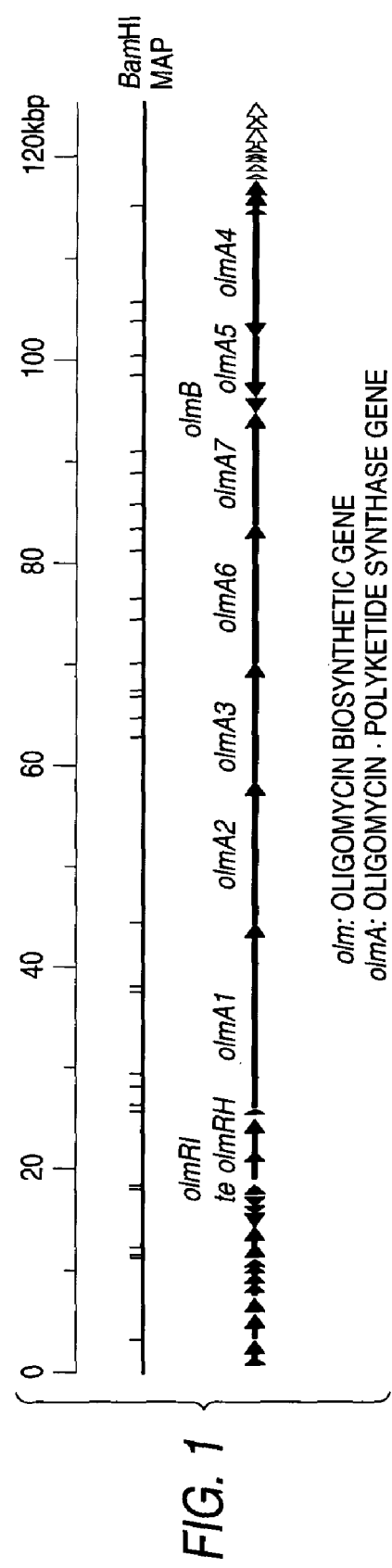
FIG. 1 is a drawing showing the construction of the gene in the region relating to the biosynthesis of oligomycin on the genome of *Streptomyces avermitilis* ATCC 31267.

This application is based on Japanese applications No. 2001-204089 filed on May 30, 2001 and No. 2001-272697 filed on Aug. 2, 2001, the entire contents of which are incorporated hereinto by reference.

From the viewpoint that the determination of the full nucleotide sequence of *Streptomyces avermitilis* would make it possible to specify gene regions which had not been previously identified, to determine the function of an unknown gene derived from the microorganism through comparison with nucleotide sequences of known genes and amino acid sequences of known genes, and to obtain a useful mutant based on the presumption of the metabolic regulatory mechanism of a useful product by the microorganism, the inventors conducted intensive studies and, as a result, found that the complete genome sequence of *Streptomyces avermitilis* can be determined by applying the whole genome shotgun method.

Specifically, the present invention relates to the following (1) to (53):

(1) A method for at least one of the following:
(A) identifying a mutation point of a gene derived from a mutant of an actinomycetes,
(B) measuring an expression amount of a gene derived from an actinomycetes,
(C) analyzing an expression profile of a gene derived from an actinomycetes,
(D) analyzing expression patterns of genes derived from an actinomycetes, or
(E) identifying a gene homologous to a gene derived from an actinomycetes,
said method comprising:
(a) producing a polynucleotide array by adhering to a solid support at least two polynucleotides selected from the group consisting of first polynucleotides comprising the nucleotide sequence represented by any one of SEQ ID NOs:1 to 7551, second polynucleotides which hybridize with the first polynucleotides under stringent conditions, and third polynucleotides comprising a sequence of 10 to 200 continuous bases of the first or second polynucleotides,
(b) incubating the polynucleotide array with at least one of a labeled polynucleotide derived from an actinomycetes, a labeled polynucleotide derived from a mutant of the actinomycetes or a labeled polynucleotide to be examined, under hybridization conditions,
(c) detecting any hybridization, and
(d) analyzing the result of the hybridization.

(2) The method according to (1), wherein the actinomycetes is a microorganism belonging to the genus *Streptomyces*, the genus *Streptosporangium*, the genus *Amycolatopsis*, the genus *Actinoplanes*, the genus *Nocardioides*, the genus *Pseudonocardia*, the genus *Actinobispora*, the genus *Saccharomonospora*, the genus *Saccharopolyspora*, the genus *Saccharothrix*, the genus *Actinopolyspora*, the genus *Actinomadura*, the genus *Microbispora*, the genus *Microtetraspora*, the genus *Thermomonospora*, or the genus *Micromonospora*.

(3) The method according to (2), wherein the microorganism belonging to the genus *Streptomyces* is selected from *Streptomyces avermitilis*.

(4) The method according to (1), wherein the labeled polynucleotide derived from an actinomycetes, the labeled polynucelotide derived from a mutant of the actinomycetes or the labeled polynucleotide to be examined is a gene relating to the biosynthesis of at least one compound selected from an amino acid, a nucleic acid, a vitamin, a saccharide, an organic acid, an antibiotic, and analogues thereof.

(5) The method according to (1), wherein the labeled polynucleotide to be examined is derived from *Escherichia coli*.

(6) A polynucleotide array, comprising:
at least two polynucleotides selected from the group consisting of first polynucleotides comprising the nucleotide sequence represented by any one of SEQ ID NOs:1 to 7551, second polynucleotides which hybridize with the first polynucleotides under stringent conditions, and third polynucleotides comprising 10 to 200 continuous bases of the first or second polynucleotides, and
a solid support adhered thereto.

(7) A polynucleotide comprising the nucleotide sequence represented by SEQ ID NOs:1 to 7551 or a polynucleotide having a homology of at least 80% with the polynucleotide.

(8) A polynucleotide comprising any one of the nucleotide sequences represented by SEQ ID NOs:2 to 7551, or a polynucleotide which hybridizes with the polynucleotide under stringent conditions.

(9) A polynucleotide encoding a polypeptide having any one of the amino acid sequences represented by SEQ ID NOs: 7552 to 15101, or a polynucleotide which hybridizes therewith under stringent conditions.

(10) A polynucleotide which is present in the 5' upstream or 3' downstream of a polynucleotide encoding a protein in a polynucleotide comprising any one of the nucleotide sequence represented by SEQ ID NOs:2 to 3431, and has an activity of regulating an expression of the polynucleotide.

(11) A polynucleotide comprising 10 to 200 continuous bases in the nucleotide sequence of the polynucleotide of any one of (7) to (10), or a polynucleotide comprising a nucleotide sequence complementary to the polynucleotide comprising 10 to 200 continuous based.

(12) A recombinant DNA comprising the polynucleotide of any one of (8) to (11).

(13) A transformant comprising the polynucleotide of any one of (8) to (11) or the recombinant DNA of (12).

(14) A method for producing a polypeptide, comprising:
culturing the transformant of (13) in a medium to produce and accumulate a polypeptide encoded by the polynucleotide of (8) or (9) in the medium, and
recovering the polypeptide from the medium.

(15) A method for producing at least one of a biological active substance comprising an antibiotic and analogues thereof, comprising:

culturing the transformant of (13) in a medium to produce and accumulate at least one of a biological active substance comprising an antibiotic and analogues thereof in the medium, and recovering the at least one of the biological substance comprising an antibiotic and analogues thereof from the medium.

(16) A polypeptide encoded by a polynucleotide comprising the nucleotide sequence selected from SEQ ID NOs:2 to 7551.

(17) A polypeptide comprising the amino acid sequence selected from SEQ ID NOs:7552 to 15101.

(18) The polypeptide according to (16) or (17), wherein at least one amino acid is deleted, replaced, inserted or added, said polypeptides having an activity which is substantially the same as that of the polypeptide without said at least one amino acid deletion, replacement, insertion or addition.

(19) A polypeptide comprising an amino acid sequence having a homology of at least 60% with the amino acid sequence of the polypeptide of (16) or (17), and having an activity which is substantially the same as that of the polypeptide.

(20) An antibody which recognizes the polypeptide of any one of (16) to (19).

(21) A polypeptide array, comprising:
at least one polypeptide or partial fragment polypeptide selected from the polypeptides of (16) to (19) and partial fragment polypeptides of the polypeptides, and a solid support adhered thereto.

(22) A polypeptide array, comprising:
at least one antibody which recognizes a polypeptide or partial fragment polypeptide selected from the polypeptides of (16) to (19) and partial fragment polypeptides of the polypeptides, and
a solid support adhered thereto.

(23) A system based on a computer for identifying a target sequence or a target structure motif derived from an actinomycetes, comprising the following:
(i) a user input device that inputs at least one nucleotide sequence information selected from SEQ ID NOs:1 to 7551, and target sequence or target structure motif information;
(ii) a data storage device for at least temporarily storing the input information;
(iii) a comparator that compares the at least one nucleotide sequence information selected from SEQ ID NOs:1 to 7551 with the target sequence or target structure motif information, recorded by the data storage device for screening and analyzing nucleotide sequence information which is coincident with or analogous to the target sequence or target structure motif information; and
(iv) an output device that shows a screening or analyzing result obtained by the comparator.

(24) A method based on a computer for identifying a target sequence or a target structure motif derived from an actinomycetes, comprising the following:
(i) inputting at least one nucleotide sequence information selected from SEQ ID NOs:1 to 7551, target sequence information or target structure motif information into a user input device;
(ii) at least temporarily storing said information;
(iii) comparing the at least one nucleotide sequence information selected from SEQ ID NOs:1 to 7551 with the target sequence or target structure motif information; and
(iv) screening and analyzing nucleotide sequence information which is coincident with or analogous to the target sequence or target structure motif information.

(25) A system based on a computer for identifying a target sequence or a target structure motif derived from an actinomycetes, comprising the following:
(i) a user input device that inputs at least one amino acid sequence information selected from SEQ ID NOs:7552 to 15101, and target sequence or target structure motif information;
(ii) a data storage device for at least temporarily storing the input information;
(iii) a comparator that compares the at least one amino acid sequence information selected from SEQ ID NOs:7552 to 15101 with the target sequence or target structure motif information, recorded by the data storage device for screening and analyzing amino acid sequence information which is coincident with or analogous to the target sequence or target structure motif information; and
(iv) an output device that shows a screening or analyzing result obtained by the comparator.

(26) A method based on a computer for identifying a target sequence or a target structure motif derived from an actinomycetes, comprising the following:
(i) inputting at least one amino acid sequence information selected from SEQ ID NOs:7552 to 15101, and target sequence information or target structure motif information into a user input device;
(ii) at least temporarily storing said information;
(iii) comparing the at least one amino acid sequence information selected from SEQ ID NOs:7552 to 15101 with the target sequence or target structure motif information; and
(iv) screening and analyzing amino acid sequence information which is coincident with or analogous to the target sequence or target structure motif information.

(27) A system based on a computer for determining a function of a polypeptide encoded by a polynucleotide having a target nucleotide sequence derived from an actinomycetes, comprising the following:
(i) a user input device that inputs at least one nucleotide sequence information selected from SEQ ID NOs:2 to 7551, function information of a polypeptide encoded by the nucleotide sequence, and target nucleotide sequence information;
(ii) a data storage device for at least temporarily storing the input information;
(iii) a comparator that compares the at least one nucleotide sequence information selected from SEQ ID NOs:2 to 7551 with the target nucleotide sequence information for determining a function of a polypeptide encoded by a polynucleotide having the target nucleotide sequence which is coincident with or analogous to the polynucleotide having at least one nucleotide sequence selected from SEQ ID NOs:2 to 7551; and
(iv) an output devices that shows a function obtained by the comparator.

(28) A method based on a computer for determining a function of a polypeptide encoded by a polypeptide encoded by a polynucleotide having a target nucleotide sequence derived from an actinomycetes, comprising the following:
(i) inputting at least one nucleotide sequence information selected from SEQ ID NOs:2 to 7551, function information of a polypeptide encoded by the nucleotide sequence, and target nucleotide sequence information;
(ii) at least temporarily storing said information;
(iii) comparing the at least one nucleotide sequence information selected from SEQ ID NOs:2 to 7551 with the target nucleotide sequence information; and
(iv) determining a function of a polypeptide encoded by a polynucleotide having the target nucleotide sequence which is coincident with or analogous to the polynucleotide having at least one nucleotide sequence selected from SEQ ID NOs:2 to 7551.

(29) A system based on a computer for determining a function of a polypeptide having a target amino acid sequence derived from an actinomycetes, comprising the following:
  (i) a user input device that inputs at least one amino acid sequence information selected from SEQ ID NOs:7552 to 15101, function information based on the amino acid sequence, and target amino acid sequence information;
  (ii) a data storing device for at least temporarily storing the input information;
  (iii) a comparator that compares the at least one amino acid sequence information selected from SEQ ID NOs:7552 to 15101 with the target amino acid sequence information for determining a function of a polypeptide having the target amino acid sequence which is coincident with or analogous to the polypeptide having at least one amino acid sequence selected from SEQ ID NOs:7552 to 15101; and
  (iv) an output device that shows a function obtained by the comparator.

(30) A method based on a computer for determining a function of a polypeptide having a target amino acid sequence derived from an actinomycetes, comprising the following:
  (i) inputting at least one amino acid sequence information selected from SEQ ID NOs:7552 to 15101, function information based on the amino acid sequence, and target amino acid sequence information;
  (ii) at least temporarily storing said information;
  (iii) comparing the at least one amino acid sequence information selected from SEQ ID NOs:7552 to 15101 with the target amino acid sequence information; and
  (iv) determining a function of a polypeptide having the target amino acid sequence which is coincident with or analogous to the polypeptide having at least one amino acid sequence selected from SEQ ID NOs:7552 to 15101.

(31) The system according to any one of (23), (25), (27) and (29), wherein an actinomycetes is a microorganism of the genus *Streptomyces*, the genus *Streptosporangium*, the genus *Amycolatopsis*, the genus *Actinoplanes*, the genus *Nocardioides*, the genus *Pseudonocardia*, the genus *Actinobispora*, the genus *Saccharomonospora*, the genus *Saccharopolyspora*, the genus *Saccharothrix*, the genus *Actinopolyspora*, the genus *Actinomadura*, the genus *Microbispora*, the genus *Microtetraspora*, the genus *Thermomonospora*, or the genus *Micromonospora*.

(32) The method according to any one of (24), (26), (28) and (30), wherein an actinomycetes is a microorganism of the genus *Streptomyces*, the genus *Streptosporangium*, the genus *Amycolatopsis*, the genus *Actinoplanes*, the genus *Nocardioides*, the genus *Pseudonocardia*, the genus *Actinobispora*, the genus *Saccharomonospora*, the genus *Saccharopolyspora*, the genus *Saccharothrix*, the genus *Actinopolyspora*, the genus *Actinomadura*, the genus *Microbispora*, the genus *Microtetraspora*, the genus *Thermomonospora*, or the genus *Micromonospora*.

(33) The system according to (31), wherein the microorganism belonging to the genus *Streptomyces* is selected from *Streptomyces avermitilis*.

(34) The method according to (32), wherein the microorganism belonging to the genus *Streptomyces* is selected from *Streptomyces avermitilis*.

(35) A recording medium or storage device which is readable by a computer in which nucleotide sequence information of SEQ ID NO:1 or function information based on the nucleotide sequence is recorded, and is usable in the system of (23) or (27) or the method of (24) or (28).

(36) A recording medium or storage device which is readable by a computer in which at least one amino acid sequence information selected from SEQ ID NOs:7552 to 15101 or function information based on the amino acid sequence is recorded, and is usable in the system of (25) or (29) or the method of (26) or (30).

(37) The recording medium or storage device according to (35) or (36), which is a computer readable recording medium selected from the group consisting of a floppy disc, a hard disc, a magnetic tape, a random access memory (RAM), a read only memory (ROM), a magneto-optic disc (MO), CD-ROM, CD-R, CD-RW, DVD-ROM, DVD-RAM and DVD-RW.

(38) A method for breeding an actinomycetes using the nucleotide sequence information represented by SEQ ID NO:1, comprising the following:
  (i) comparing a nucleotide sequence of a genome or gene of a production strain derived an actinomycetes which has been subjected to mutation breeding so as to produce at least one compound selected from an amino acid, a nucleic acid, a vitamin, a saccharide, an organic acid, an antibiotic, and analogous thereof by a fermentation method, with a corresponding nucleotide sequence in SEQ ID NO:1;
  (ii) identifying a mutation point present in the production strain based on a result obtained by (i);
  (iii) introducing the mutation point into an actinomycetes which is free of the mutation point, or deleting the mutation point from an actinomycetes having the mutation point; and
  (iv) examining productivity by the fermentation method of the compound selected in (i) of the actinomycetes obtained in (iii).

(39) The method according to (38), wherein the gene is a gene encoding an enzyme in a biosynthetic pathway or a signal transmission pathway.

(40) The method according to (38), wherein the mutation point is a mutation point relating to a useful mutation which improves or stabilizes the productivity.

(41) A method for breeding an actinomycetes using the nucleotide sequence information represented by SEQ ID NO:1, comprising:
  (i) comparing a nucleotide sequence of a genome or gene of a production strain derived an actinomycetes which has been subjected to mutation breeding so as to produce at least one compound selected from a biological active substance comprising an antibiotic and analogous thereof by a fermentation method, with a corresponding nucleotide sequence in SEQ ID NO:1;
  (ii) identifying a mutation point present in the production strain based on a result obtain by (i);
  (iii) deleting a mutation point from an actinomycetes having the mutation point; and
  (iv) examining productivity by the fermentation method of the compound selected in (i) of the actinomycetes obtained in (iii).

(42) The method according to (41), wherein the gene is a gene encoding an enzyme in a biosynthetic pathway or a signal transmission pathway.

(43) The method according to (41), wherein the mutation point is a mutation point which decreases or destabilizes the productivity.

(44) A method for breeding an actinomycetes using the nucleotide sequence information represented by SEQ ID NOs:2 to 7551, comprising the following:
  (i) identifying an isozyme relating to biosynthesis of at least one compound selected from an amino acid, a nucleic acid, a vitamin, a saccharide, an organic acid, an antibiotic, and analogous thereof, based on the nucleotide sequence information represented by SEQ ID NOs:2 to 7551;
(ii) classifying the isozyme identified in (i) into an isozyme having the same activity;
(iii) mutating all genes encoding the isozyme having the same activity simultaneously; and
(iv) examining productivity by a fermentation method of the compound selected in (i) of the actinomycetes which have been transformed with the gene obtained in (iii).
(45) A method for breeding an actinomycetes using the nucleotide sequence information represented by SEQ ID NOs:2 to 7551, comprising the following:
(i) arranging a function information of an open reading frame (ORF) represented by SEQ ID NOs:2 to 7551;
(ii) allowing the arranged ORF to correspond to an enzyme on a known biosynthesis or signal transmission pathway;
(iii) explicating an unknown biosynthesis pathway or signal transmission pathway of an actinomycetes in combination with information relating known biosynthesis pathway or signal transmission pathway of an actinomycetes;
(iv) comparing the pathway explicated in (iii) with a biosynthesis pathway of a target useful product; and
(v) transgenetically varying an actinomycetes based on the nucleotide sequence information represented by SEQ ID NOs:2 to 7551 to either strengthen a pathway which is judged to be important in the biosynthesis of the target useful product in (iv) or weaken a pathway which is judged not to be important in the biosynthesis of the target useful product in (iv).
(46) A actinomycetes, bred by the method of any one of (38) to (45).
(47) The actinomycetes according to (46), which is a microorganism belonging to the genus *Streptomyces*, the genus *Streptosporangium*, the genus *Amycolatopsis*, the genus *Actinoplanes*, the genus *Nocardioides*, the genus *Pseudonocardia*, the genus *Actinobispora*, the genus *Saccharomonospora*, the genus *Saccharopolyspora*, the genus *Saccharothrix*, the genus *Actinopolyspora*, the genus *Actinomadura*, the genus *Microbispora*, the genus *Microtetraspora*, the genus *Thermomonospora*, or the genus *Micromonospora*.
(48) The actinomycetes according to (47), wherein the microorganism belonging to the genus *Streptomyces* is selected from *Streptomyces avermoitilis*.
(49) A method for producing at least one compound selected from an amino acid, a nucleic acid, a vitamin, a saccharide, an organic acid, an antibiotic, and an analogue thereof, comprising:
culturing an actinomycetes of any one of (46) to (48) in a medium to produce and accumulate at least one compound selected from an amino acid, a nucleic acid, a vitamin, a saccharide, an organic acid, an antibiotic, and analogues thereof;
recovering the compound from the culture.
(50) The method according to (49), wherein the compound is polyketide.
(51) A method for identifying a protein relating to useful mutation based on proteome analysis, comprising the following:
(i) preparing
a protein derived from a bacterium of a production strain of an actinomycetes which has been subjected to mutation breeding by a fermentation process so as to produce at least one compound selected from an amino acid, a nucleic acid, a vitamin, a saccharide, an organic acid, an antibiotic, and analogues thereof, and a protein derived from a bacterium of a parent strain of the production strain;
(ii) separating the proteins prepared in (i) by two dimensional electrophoresis;
(iii) detecting the separated proteins, and comparing an expression amount of the protein derived from the production strain with that derived from the parent strain;
(iv) treating the protein showing different expression amounts as a result of the comparison with a peptidase to extract peptide fragments;
(v) analyzing amino acid sequences of the peptide fragments obtained in (iv); and
(vi) comparing the amino acid sequences obtained in (v) with the amino acid sequence represented by SEQ ID NOs:7552 to 15101 to identifying the protein having the amino acid sequences.
(52) The method according to (51), wherein the actinomycetes is a microorganism belonging to the genus *Streptomyces*, the genus *Streptosporangium*, the genus *Amycolatopsis*, the genus *Actinoplanes*, the genus *Nocardioides*, the genus *Pseudonocardia*, the genus *Actinobispora*, the genus *Saccharomonospora*, the genus *Saccharopolyspora*, the genus *Saccharothrix*, the genus *Actinopolyspora*, the genus *Actinomadura*, the genus *Microbispora*, the genus *Microtetraspora*, the genus *Thermomonospora*, or the genus *Micromonospora*.
(53) The method according to (52), wherein the microorganism belonging to the genus *Streptomyces* is selected from *Streptomyces avermitilis*.

The present invention will be described below in more detail, based on the determination of the full nucleotide sequence of actinomycetes.

1. Determination of Full Nucleotide Sequence of Actinomycetes

The term "actinomycetes" as used herein means a microorganism belonging to the genus *Streptomyces*, the genus *Streptosporangium*, the genus *Amycolatopsis*, the genus *Actinoplanes*, the genus *Nocardioides*, the genus *Pseudonocardia*, the genus *Actinobispora*, the genus *Saccharomonospora*, the genus *Saccharopolyspora*, the genus *Saccharothrix*, the genus *Actinopolyspora*, the genus *Actinomadura*, the genus *Microbispora*, the genus *Microtetraspora*, the genus *Thermomonospora*, or the genus *Micromonospora* as defined in Bergeys Manual of Determinative Bacteriology, 8: 599 (1974).

Examples include *Streptomyces avermitilis*, *Streptomyces griseus*, *Streptomyces hygroscopicus*, and the like.

Specific examples include *Streptomyces avenmitilis* ATCC 31267 and the like.

(1) Preparation of Genome DNA of Actinomycetes

Actinomycetes can be cultured by a conventional method. Any of a natural medium and a synthetic medium can be used, so long as it is a medium suitable for efficient culturing of the microorganism, and it contains a carbon source, a nitrogen source, an inorganic salt, and the like which can be assimilated by the microorganism.

In *Streptomyces avermitilis*, for example, TSB medium (17 g/l peptone, 3 g/l soybean peptone, 5 g/l sodium chloride, 2.5 g/l glucose, 2.5 g/l potassium secondary phosphate, pH 7.3) and the like can be used. The culturing is carried out at 25 to 35° C. overnight.

After the completion of the culture, the cells are recovered from the culture by centrifugation. The resulting cells are washed with a washing solution.

Examples of the washing solution include STE buffer (10.3% sucrose, 25 mmol/l Tris hydrochloride, 25 mmol/l ethylenediaminetetraacetic acid (hereinafter referred to as "EDTA"), pH 8.0), and the like.

In order to obtain genome DNA from the washed cells, the cells are wrapped with agarose, the cell wall of the cells is lysed using a lysozyme and a surfactant (SDS, sarcosyl, etc.), proteins are decomposed with proteinase K. Furthermore, agarose gel block comprising the genome DNA is subjected to field-inversion electrophoresis to eliminate linear plasmids. Specifically, the following method can be illustrated.

Washed cells obtained from a 5 ml culturing solution are suspended in 2.5 ml of STE buffer, and mixed with 2.5 ml of 1.5% low melting point agarose for preparing a pulse field electrophoresis sample (InCert agarose, manufactured by Takara Shuzo). The mixture is poured into a Petri dish having a 80 mm diameter, allowed to stand at room temperature for at least 30 minutes, and solidified. STE buffer (20 ml) containing lysozyme (1 to 5 mg/ml) is added thereto, and the mixture is kept at 30° C. for 6 to 20 hours to thereby digest the cell wall. The STE buffer is removed, the cells are washed with TE buffer (10 mmol/l Tris hydrochloride, 1 mmol/l EDTA, pH 8.0), 10 ml of a lysis buffer (0.5 mmol/l EDTA, pH 9.5, 1% sarcosyl) containing 1 mg/ml proteinase K is added thereto, and the mixture is gently shaken at 50° C. for 24 hours for lysis. After lysis, the buffer is removed, and the residue is washed with 20 ml of a 50 mmol/l EDTA solution of pH 8.0 several times. Additionally, 20 ml of a 50 mmol/l EDTA solution containing 1 mM PMSF of pH 8.0 is added thereto to thereby inactivate the remaining proteinase K.

Agarose gel containing genome DNA is cut out as a block of 5×5 mm, put into a sample ditch, an electrophoresis buffer is filled, and electrophoresis is carried out under pulse conditions of 3 seconds for a forward direction and 1 second for a backward direction at 120 volts overnight. After the electrophoresis, the agarose gel is taken out and washed with a 50 mmol/l EDTA solution of pH 8.0. The washed agarose gel is dissolved by incubation at 65° C. Tris neutral phenol (5 to 10 ml) is added thereto, followed by gently shaking at room temperature for 5 minutes, and then 5 to 10 ml of chloroform is further added thereto, followed by gently shaking for 5 minutes.

After shaking, centrifugation (10,000×g, 10 minutes, 20° C.) is carried out, and the aqueous phase is collected. The aqueous phase is subjected to extraction with 10 to 20 ml of phenol/chloroform twice, and then 1/10 volume of a 3 mol/l sodium acetate solution and 0.56 volume of isopropanol are added to the aqueous phase, followed by gently mixing to thereby precipitate genome DNA. The resulting genome DNA precipitate is washed with 70% ethanol, followed by air drying, and then dissolved in TE buffer to obtain a genome DNA solution.

(2) Construction of Shotgun Library

A method for produce a genome DNA library using the genome DNA of the actinomycetes prepared in the above (1) include a method described in *Molecular Cloning, A laboratory Manual*, Second Edition (1989) (hereinafter referred to as "*Molecular Cloning*, 2nd ed."). In particular, the following method can be exemplified to prepare a genome DNA library appropriately usable in determining the full nucleotide sequence by the shotgun method.

To 0.01 mg of the genome DNA of the actinomycetes prepared in the above (1), a buffer, such as TE buffer or the like, is added to give a total volume of 0.4 ml. Then, the genome DNA is cut by shearing force into fragments of 1 to 2 kb with HydroShare (manufactured by Gene Machines).

The treatment with the HydroShare is performed at an output of 6 twenty times. The resulting genome DNA fragments are passed through Size Sep 400 Span Column (Sepharose CL4B, manufactured by Amersham) to thereby remove fragments of 500 bp or less. The DNA fragments from which the fragments of 500 bp or less have been eliminated are blunt-ended using DNA blunting kit (manufactured by Takara Shuzo) or the like.

The resulting DNA eluate is treated with phenol/chloroform and then precipitated with ethanol to obtain a genome library insert.

The insert is ligated into a suitable vector, such as pUC18 HincII/BAP (manufactured by Takara Shuzo) or the like, using T4 DNA ligase (manufactured by Takara Shuzo) or the like. The ligation can be carried out by allowing a mixture to stand at 10 to 20° C. for 20 to 50 hours.

The resulting ligation product is precipitated with ethanol and dissolved in 5 to 20 µl of TE buffer. *Escherichia coli* is transformed in accordance with a conventional method using 0.5 to 2 µl of the ligation solution. Examples of the transformation method include electroporation using *Escherichia coli* DH5α. Electroporation can be carried out at 10 to 25 kV/cm.

The transformed *Escherichia coli* is spread on a suitable selection medium containing agar, for example, LB plate medium containing 10 to 100 mg/l ampicillin (LB medium (10 g/l bactotrypton, 5 g/l yeast extract, 10 g/l sodium chloride, pH 7.0) containing 1.5% of agar) when pUC18 is used as the cloning vector, and cultured therein. The transformant can be obtained as colonies formed on the plate medium. In this step, it is possible to select the transformant having the recombinant DNA containing the genome DNA as white colonies by adding X-gal (5-bromo-4-chloro-3-indolyl-β-D-galactopyranoside) and IPTG (isopropyl-β-thiogalactopyranoside) to the plate medium.

The transformant is allowed to stand for culturing in a 96-well titer plate to which 0.05 ml of the LB medium containing 0.1 mg/ml ampicillin has been added in each well. The resulting culture can be used in an experiment of (4) described below. Also, the culture solution can be stored at −80° C. by adding 0.05 ml per well of the LB medium containing 20% glycerol to the culture solution, followed by mixing, and the stored culture solution can be used at any time.

(3) Construction of Cosmid Library

The genome DNA (0.1 mg) of the actinomycetes prepared in the above (1) is partially digested with a restriction enzyme, such as MboI or the like, and then subjected to field-inversion electrophoresis using a low melting point agarose gel.

After the electrophoresis, agarose gel fractions mainly containing DNA fragments of about 40 kb are collected, and the agarose gel is dissolved at 65° C. After dissolution, phenol treatment and chloroform treatment are carried out in this order, and then the aqueous phase is collected, followed by ethanol precipitation.

The resulting DNA fragment is ligated to a cosmid vector having a cohesive end which can be ligated to the fragment. When the genome DNA is partially digested with MhoI, the partially digested product can be ligated to, for example, the BamHI site of pKU402 (*Actonomycetol*, 8: 21-25 (1994)).

The resulting ligation product is packaged using a packaging extract which can be prepared by a method described in *Molecular Cloning*, 2nd ed. and then used in transforming *Escherichia coli*. More specifically, the ligation product is packaged using, for example, a commercially available packaging extract, Ready-To-Go Lambda Packaging Kit (manufactured by Amersham) in accordance with the manufacture's instructions and then introduced into *Escherichia coli* XL-1-BlueMR (manufactured by Stratagene) or the like.

The thus transformed *Escherichia coli* is spread on an LB plate medium containing ampicillin, and cultured therein. The transformant can be obtained as colonies formed on the plate medium. The transformant is subjected to standing culture in a 96-well titer plate to which 0.05 ml of the LB medium containing 0.1 mg/ml ampicillin has been added.

The resulting culture can be employed in an experiment of (4) described below. Also, the culture solution can be stored at −80° C. by adding 0.05 ml per well of the LB medium containing 50% glycerol to the culture solution, followed by mixing, and the stored culture solution can be used at any time.

(4) Determination of Nucleotide Sequence (4-1) Preparation of Template

The full nucleotide sequence of genome DNA of actinomycetes can be determined basically according to the whole genome shotgun method (*Science,* 269: 496-512 (1995)).

The template used in the whole genome shotgun method can be prepared by PCR using the library prepared in the above (2) (*DNA Research,* 5: 1-9 (1998)).

Specifically, the template can be prepared as follows.

The clone derived from the whole genome shotgun library is inoculated by using a replicator (manufactured by GENETIX) into each well of a 96-well plate to which 0.08 ml per well of the LB medium containing 0.1 mg/ml ampicillin has been added, followed by static culturing at 37° C. overnight.

The culturing solution is diluted 40 folds with sterilized water, a 5 RI portion thereof is mixed with 5 μl of a solution containing 100 μg/ml M13 forward (GTGCTGCAAGGC-GATTAAGTTGG; SEQ ID NO:15104) and reverse primer (TCCGGCTCGTATGTTGTGTGGA; SEQ ID NO:15105), Ex Taq buffer (manufactured by Takara Shuzo), 5 mmol/l dATP, dGTP, dCTP and dTTP, and 0.25 U of TaKaRa Ex Taq (manufactured by Takara Shuzo), and amplification of inserted fragments is carried out using Biometra (manufactured by Biotron) at 96° C. for 5 minutes and a succeeding cycle of 96° C. for 15 seconds and 70° C. for 60 seconds 20 to 40 times. Also, 96-well reaction plate (manufactured by PE Biosystems) is used for the amplification.

The excessive primers and nucleotides are eliminated using a kit for purifying a PCR product, and the product is used as the template in the sequencing reaction.

A part of the nucleotide sequence can be determined using a double-stranded DNA plasmid as a template. The double-stranded DNA plasmid used as the template can be obtained by the following method. The clone derived from the whole genome shotgun library is inoculated into each well of a 96-well plate to which 1 ml per well of a TSB medium (17 g/l peptone, 3 g/l soybean peptone, 5 g/l sodium chloride, 2.5 g/l glucose, 2.5 g/l potassium secondary phosphate, pH 7.3) containing 0.1 mg/ml ampicillin has been added, followed by culturing under shaking at 30° C. overnight. The double-stranded DNA plasmid can be prepared from the culture solution using an automatic plasmid preparing machine KURABO PI-50 (manufactured by Kurabo Industries), a multiscreen (manufactured by Millipore) or the like, according to each protocol. The resulting purified double-stranded DNA plasmid is dissolved in water to give a concentration of about 0.1 mg/ml. Then, it can be used as the template in sequencing.

(4-2) Sequencing Reaction

The sequencing reaction can be carried out according to a commercially available sequence kit or the like. A specific method is exemplified below.

To 6 μl of a solution of ABI PRISM BigDye Terminator Cycle Sequencing Ready Reaction Kit (manufactured by PE Biosystems), 1 to 2 pmol of an M13 regular direction primer (M13-21) or an M13 reverse direction primer (M13REV) (*DNA Research,* 5: 1-9 (1998)) and 50 to 200 ng of the template prepared in the above (4-1) (the PCR product or plasmid) to give 10 μl of a sequencing reaction solution.

A dye terminator sequencing reaction (35 to 55 cycles) is carried out using this reaction solution and Biometra (manufactured by Biotron) or the like. The cycle parameter can be determined in accordance with a commercially available kit, for example, the manufacture's instructions attached with ABI PRISM Big Dye Terminator Cycle Sequencing Ready Reaction Kit.

The sample can be purified using a commercially available product, such as Multi Screen HV plate (manufactured by Millipore) or the like, using Sephadex G50 (manufactured by Pharmacia) according to the manufacture's instructions.

The thus purified reaction product is used for the analysis directly. The dried reaction product can be stored in the dark at −20° C. and the stored reaction product can be used at any time.

The reaction product can be analyzed using a commercially available sequencer and an analyzer according to the manufacture's instructions.

Examples of the commercially available sequencer include ABI 3700 DNA Sequencer (manufactured by PE Biosystems), Mega Bace 1000 Sequencer (manufactured by Amersham) and the like. Example of the analyzer include ABI PRISM 3700 DNA Analyzer (manufactured by PE Biosystems) and the like.

(5) Assembly

A software, such as phred (The University of Washington) or the like, can be used as base call for use in analyzing the sequence information obtained in the above (4). A software, such as Cross_Match (The University of Washington) or SPS Cross_Match (manufactured by Southwest Parallel Software) or the like, can be used to mask the vector sequence information.

For the assembly, a software, such as phrap (The University of Washington), SPS phrap (manufactured by Southwest Parallel Software) or the like, can be used.

In the above, analysis and output of the results thereof, a computer such as UNIX, Windows, Macintosh, and the like can be used. Contig obtained by the assembly can be analyzed using a graphical editor such as consed (The University of Washington) or the like. It is also possible to perform a series of the operations from the base call to the assembly in a lump using a script phredphrapi attached to the consed.

As used herein, the software will be understood to also be referred to as a comparator.

(6) Determination of Nucleotide Sequence in Gap Part

Each of the cosmids in the cosmid library constructed in the above (3) is prepared in the same manner as in the preparation of the double-stranded DNA plasmid described in the above (4-1). The nucleotide sequence at the end of the insert fragment of the cosmid is determined using a commercially available kit, such as ABI PRISM BigDye Terminator Cycle Sequencing Ready Reaction Kit (manufactured by PE Biosystems) according to the manufacture's instructions.

About 4,000 cosmid clones are sequenced at both ends of the inserted fragment to detect a nucleotide sequence in the contig derived from the shotgun sequencing obtained in (5) which is coincident with the sequence. Thus, the chain linkage between respective cosmid clones and respective contigs are clarified, and mutual alignment is carried out.

The sequence in the region which cannot be covered with the contigs (gap part) can be determined by the following method. Clones containing sequences positioned at the ends of the contigs are selected. Among these, a clone wherein only one end of the inserted fragment has been determined is selected and the sequence at the opposite end of the inserted fragment is determined. A shotgun library clone or a cosmid clone derived therefrom containing the sequences at the respective ends of the inserted fragments in the two contigs is identified and the full nucleotide sequence of the inserted fragment of the clone is determined. According to this method, the nucleotide sequence of the gap part can be determined. When no shotgun library clone or cosmid clone covering the gap part is available, primers complementary to the end sequences of the two different contigs are prepared and the DNA fragment in the gap part is amplified. Then, sequencing is performed by the primer walking method using the amplified DNA fragment as a template or by the shotgun method in which the sequence of a shotgun clone prepared from the amplified DNA fragment is determined. Thus, the nucleotide sequence of the above-described region can be determined.

In a region showing a low sequence accuracy, primers are synthesized using AUTOFINISH function and NAVIGATING function of consed (The University of Washington), and the sequence is determined by the primer walking method to improve the sequence accuracy.

Examples of the thus determined nucleotide sequence of the full genome include the full nucleotide sequence of genome of *Streptomyces avermitilis* ATCC 31267 represented by SEQ ID NO:1.

(7) Determination of Nucleotide Sequence of Microorganism Genome DNA Using the Nucleotide Sequence Represented by SEQ ID NO:1

A nucleotide sequence of a polynucleotide having a homology of 80% or more with the full nucleotide sequence of *Streptomyces avermitilis* ATCC 31267 represented by SEQ ID NO:1 as determined above can also be determined using the nucleotide sequence represented by SEQ ID NO:1, and the polynucleotide having a nucleotide sequence having a homology of 80% or more with the nucleotide sequence represented by SEQ ID NO:1 of the present invention is within the scope of the present invention. The term "polynucleotide having a nucleotide sequence having a homology of 80% or more with the nucleotide sequence represented by SEQ ID NO:1 of the present invention" is a polynucleotide in which a full nucleotide sequence of the chromosome DNA can be determined using as a primer an oligonucleotide composed of continuous 5 to 50 nucleotides in the nucleotide sequence represented by SEQ ID NO:1, for example, according to PCR using the chromosome DNA as a template.

A particularly preferred primer in determination of the full nucleotide sequence is an oligonucleotide having nucleotide sequences which are positioned at the interval of about 300 to 500 bp, and among such oligonucleotides, an oligonucleotide having a nucleotide sequence selected from DNAs encoding a protein relating to a main metabolic pathway is particularly preferred. The polynucleotide in which the full nucleotide sequence of the chromosome DNA can be determined using the oligonucleotide includes polynucleotides constituting a chromosome DNA derived from a microorganism belonging to actinomycetes. Such a polynucleotide is preferably a polynucleotide constituting chromosome DNA derived from a microorganism belonging to the genus *Streptomyces*, more preferably a polynucleotide constituting a chromosome DNA of *Streptomyces avermitilis*.

2. Identification of ORF (Open Reading Frame) and Expression Regulatory Fragment and Determination of the Function of ORF Based on the full nucleotide sequence data of the genome derived from actinomycetes determined in the above item 1, an ORF and an expression modulating fragment can be identified. Furthermore, the function of the thus determined ORF can be determined.

The ORF means a continuous region in the nucleotide sequence of mRNA which can be translated as an amino acid sequence to mature to a protein. A region of the DNA coding for the ORF of mRNA is also called ORF.

The expression modulating fragment (hereinafter referred to as "EMF") is used herein to define a series of polynucleotide fragments which modulate the expression of the ORF or another sequence ligated operatably thereto. The expression "modulate the expression of a sequence ligated operatably" is used herein to refer to changes in the expression of a sequence due to the presence of the EMF. Examples of the EMF include a promoter, an operator, an enhancer, a silencer, a ribosome-binding sequence, a transcriptional termination sequence, and the like. In actinomycetes, an EMF is usually present in an intergenic segment (a fragment positioned between two genes; about 10 to 200 nucleotides in length). Accordingly, an EMF is frequently present in an intergenic segment of 10 nucleotides or longer. It is also possible to determine or discover the presence of an EMF by using known EMF sequences as a target sequence or a target structural motif (or a target motif) using an appropriate software or comparator, such as FASTA (*Proc. Natl. Acad. Sci. USA*, 85: 2444-48 (1988)), BLAST (*J. Mol. Biol.*, 215: 403-410 (1990)) or the like. Also, it can be identified and evaluated using a known EMF-capturing vector (for example, pKK232-8; manufactured by Amersham Pharmacia Biotech).

The term "target sequence" is used herein to refer to a nucleotide sequence composed of 6 or more nucleotides, an amino acid sequence composed of 2 or more amino acids, or a nucleotide sequence encoding this amino acid sequence composed of 2 or more amino acids. A longer target sequence appears at random in a database at the lower possibility. The target sequence is preferably about 10 to 100 amino acid residues or about 30 to 300 nucleotide residues.

The term "target structural motif" or "target motif" is used herein to refer to a sequence or a combination of sequences selected optionally and reasonably. Such a motif is selected on the basis of the three-dimensional structure formed by the folding of a polypeptide by means known to one of ordinary skill in the art. Various motives are known.

Examples of the target motif of a polypeptide include, but are not limited to, an enzyme activity site, a protein-protein interaction site, a signal sequence, and the like. Examples of the target motif of a nucleic acid include a promoter sequence, a transcriptional regulatory factor binding sequence, a hair pin structure, and the like.

Examples of highly useful EMF include a high-expression promoter, an inducible-expression promoter, and the like. Such an EMF can be obtained by positionally determining the nucleotide sequence of a gene which is known or expected as achieving high expression (for example, ribosomal RNA gene: GenBank Accession No. M16175 or Z46753) or a gene showing a desired induction pattern (for example, isocitrate lyase gene induced by acetic acid: Japanese Published Unexamined Patent Application No. 56782/93) via the alignment with the full genome nucleotide sequence determined in the above item 1, and isolating the genome fragment in the upstream part (usually 200 to 500 nucleotides from the translation initiation site). It is also possible to obtain a highly useful EMF by selecting an EMF showing a high expression efficiency or a desired induction pattern from among promoters captured by the EMF-capturing vector as described above.

The ORF can be identified by extracting characteristics common to individual ORF's, constructing a general model based on these characteristics, and measuring the conformity of the subject sequence with the model. In the identification, a software, such as GeneMark (*Nuc. Acids. Res.*, 22: 4756-67 (1994): manufactured by GenePro)), GeneMark.hmm (manufactured by GenePro), GeneHacker (*Protein, Nucleic Acid and Enzyme*, 42: 3001-07 (1997)), Glimmer (*Nuc. Acids. Res.*, 26: 544-548 (1998): manufactured by The Institute of Genomic Research), or the like, can be used. In using the software, the default (initial setting) parameters are usually used, though the parameters can be optionally changed.

In the above-described comparisons, a computer, such as UNIX, Windows, Macintosh, or the like, can be used. Examples of the ORF determined by the method of the present invention include ORFs having the nucleotide sequences represented by SEQ ID NOs:2 to 7551 present in the genome of *Streptomyces avermitilis* as represented by SEQ ID NO:1. In these ORFs, polypeptides having the amino acid sequences represented by SEQ ID NOs:7552 to 15101 are encoded.

The function of an ORF can be determined by comparing the identified amino acid sequence of the ORF with known homologous sequences using a homology searching software or comparator, such as BLAST, FAST, Smith & Waterman (*Meth. Enzym.*, 164: 765 (1988)) or the like on an amino acid database, such as Swith-Prot, PIR, GenBank-nr-aa, GenPept constituted by protein-encoding domains derived from Gen-Bank database, OWL or the like.

Furthermore, by the homology searching, the identity and similarity with the amino acid sequences of known proteins can also be analyzed. With respect of the term "identity" used herein, where two polypeptides each having 10 amino acids are different in the positions of 3 amino acids, these polypeptides have an identity of 70% with each other. In case wherein one of the different 3 amino acids is analogue (for example, leucine and isoleucine), these polypeptides have a similarity of 80%.

Thus, a great number of novel genes derived from actinomycetes can be identified by determining the full nucleotide sequence of the genome derived from actinomycetes by the means of the present invention. Moreover, the function of the proteins encoded by these genes can be determined. Since actinomycetes are industrially highly useful microorganisms, many of the identified genes are industrially useful.

Moreover, the characteristics of respective microorganisms can be clarified by classifying the functions thus determined. As a result, valuable information in breeding is obtained.

Furthermore, from the ORF information derived from actinomycetes, the ORF corresponding to the microorganism is prepared and obtained according to the general method as disclosed in *Molecular Cloning*, 2nd ed. or the like. Specifically, an oligonucleotide having a nucleotide sequence adjacent to the ORF is synthesized, and the ORF can be isolated and obtained using the oligonucleotide as a primer and a chromosome DNA derived from actinomycetes as a template according to the general PCR cloning technique. Thus obtained ORF sequences include polynucleotides comprising the nucleotide sequence represented by any one of SEQ ID NOs:2 to 7551.

The ORF or primer can be prepared using a polypeptide synthesizer based on the above sequence information.

Examples of the polynucleotide of the present invention include a polynucleotide containing the nucleotide sequence of the ORF obtained in the above, and a polynucleotide which hybridizes with the polynucleotide under stringent conditions. The polynucleotide of the present invention can be a single-stranded DNA, a double-stranded DNA and a single-stranded RNA, though it is not limited thereto.

The polynucleotide which hybridizes with the polynucleotide containing the nucleotide sequence of the ORF obtained in the above under stringent conditions includes a degenerated mutant of the ORF. A degenerated mutant is a polynucleotide fragment having a nucleotide sequence which is different from the sequence of the ORF of the present invention which encodes the same amino acid sequence by degeneracy of a gene code.

Specific examples include a polynucleotide comprising the nucleotide sequence represented by any one of SEQ ID NOs:1 to 7551, and a polynucleotide which hybridizes with the polynucleotide under stringent conditions.

A polynucleotide which hybridizes under stringent conditions is a polynucleotide obtained by colony hybridization, plaque hybridization, Southern blot hybridization or the like using, as a probe, the polynucleotide having the nucleotide sequence of the ORF identified in the above. Specific examples include a polynucleotide which can be identified by carrying out hybridization at 65° C. in the presence of 0.7-1.0 M NaCl using a filter on which a polynucleotide prepared from colonies or plaques is immobilized, and then washing the filter with 0.1× to 2×SSC solution (the composition of 1×SSC contains 150 mM sodium chloride and 15 mM sodium citrate) at 65° C.

The hybridization can be carried out in accordance with known methods described in, for example, *Molecular Cloning*, 2nd ed., *Current Protocols in Molecular Biology, DNA Cloning 1: Core Techniques, A Practical Approach*, Second Edition, Oxford University (1995) or the like. Specific examples of the polynucleotide which can be hybridized include a DNA having a homology of 60% or more, preferably 80% or more, and particularly preferably 95% or more, with the nucleotide sequence represented by any one of SEQ ID NOs:2 to 7551 when calculated using default (initial setting) parameters of a homology searching software, such as BLAST, FASTA, Smith-Waterman or the like.

Also, the polynucleotide of the present invention includes a polynucleotide encoding a polypeptide comprising the amino acid sequence represented by any one of SEQ ID NOs:7552 to 15101 and a polynucleotide which hybridizes with the polynucleotide under stringent conditions.

Furthermore, the polynucleotide of the present invention includes a polynucleotide which is present in the 5' upstream or 3' downstream region of a polynucleotide comprising the nucleotide sequence of any one of SEQ ID NOs:2 to 7551 in a polynucleotide comprising the nucleotide sequence represented by SEQ ID NO:1, and has an activity of regulating an expression of a polypeptide encoded by the polynucleotide. Specific examples of the polynucleotide having an activity of regulating an expression of a polypeptide encoded by the polynucleotide includes a polynucleotide encoding the above described EMF, such as a promoter, an operator, an enhancer, a silencer, a ribosome-binding sequence, a transcriptional termination sequence, and the like.

The primer used for obtaining the ORF according to the above PCR cloning technique includes an oligonucleotide comprising a sequence which is the same as a sequence of 10 to 200 continuous nucleotides in the nucleotide sequence of the ORF and an adjacent region or an oligonucleotide comprising a sequence which is complementary to the oligonucleotide. Specific examples include an oligonucleotide comprising a sequence which is the same as a sequence of 10 to 200 continuous nucleotides of the nucleotide sequence represented by any one of SEQ ID NOs:1 to 7551, and an oligonucleotide comprising a sequence complementary to the oligonucleotide comprising a sequence of at least 10 to 20 continuous nucleotide of any one of SEQ ID NOs:1 to 7551. When the primers are used as a sense primer and an antisense primer, the above-described oligonucleotides in which melting temperature ($T_m$) and the number of nucleotides are not significantly different from each other are preferred.

The oligonucleotide of the present invention includes an oligonucleotide comprising a sequence which is the same as 10 to 200 continuous nucleotides of the nucleotide sequence represented by any one of SEQ ID NOs:1 to 7551 or an oligonucleotide comprising a sequence complementary to the oligonucleotide.

Also, analogues of these oligonucleotides (hereinafter also referred to as "analogous oligonucleotides") are also provided by the present invention and are useful in the methods described herein.

Examples of the analogous oligonucleotides include analogous oligonucleotides in which a phosphodiester bond in an oligonucleotide is converted to a phosphorothioate bond, analogous oligonucleotides in which a phosphodiester bond in an oligonucleotide is converted to an N3'-P5' phosphoamidate bond, analogous oligonucleotides in which ribose and a phosphodiester bond in an oligonucleotide is converted to a peptide nucleic acid bond, analogous oligonucleotides in which uracil in an oligonucleotide is replaced with C-5 propynyluracil, analogous oligonucleotides in which uracil in an oligonucleotide is replaced with C-5 thiazoluracil, analogous oligonucleotides in which cytosine in an oligonucleotide is replaced with C-5 propynylcytosine, analogous oligonucleotides in which cytosine in an oligonucleotide is replaced with phenoxazine-modified cytosine, analogous oligonucleotides in which ribose in an oligonucleotide is replaced with 2'-O-propylribose, analogous oligonucleotides in which ribose in an oligonucleotide is replaced with 2'-methoxyethoxyribose, and the like (Cell *Engineering*, 16: 1463 (1997)).

The above oligonucleotides and analogous oligonucleotides of the present invention can be used as probes for hybridization and antisense nucleic acids described below in addition to as primers.

Examples of a primer for the antisense nucleic acid techniques known in the art include an oligonucleotide which hybridizes the oligonucleotide of the present invention under stringent conditions and has an activity regulating expression of the polypeptide encoded by the polynucleotide, in addition to the above oligonucleotide.

3. Determination of Isozymes

Many biological active substances are produced using actinomycetes.

Examples of the biological active substances include amino acids, nucleic acids, vitamins, saccharides, organic acids, antibiotics, and the like.

Many mutants of actinomycetes which are useful in the production of useful biological active substances are obtained.

However, since the gene sequence data of the microorganism has been, to date, insufficient, useful mutants have been obtained by mutagenic techniques using a mutagen, such as nitrosoguanidine (NTG) or the like.

Although genes can be mutated randomly by the mutagenic method using the above-described mutagen, all genes encoding respective isozymes having similar properties relating to the metabolism of intermediates cannot be mutated. In the mutagenic method using a mutagen, genes are mutated randomly. Accordingly, harmful mutations worsening culture characteristics, such as delay in growth, accelerated foaming, and the like, might be imparted at a great frequency, in a random manner.

However, if gene sequence information is available, such as is provided by the present invention, it is possible to mutate all of the genes encoding target isozymes. In this case, harmful mutations may be avoided and the target mutation can be incorporated.

Namely, an accurate number and sequence information of the target isozymes in actinomycetes can be obtained based on the ORF data obtained in the above item 2. By using the sequence information, all of the target isozyme genes can be mutated into genes having the desired properties by, for example, the site-specific mutagenesis method described in *Molecular Cloning*, 2nd ed. to obtain useful mutants having elevated productivity of useful substances.

4. Clarification or Determination of Biosynthesis Pathway and Signal Transmission Pathway Attempts have been made to elucidate biosynthesis pathways and signal transmission pathways in a number of organisms, and many findings have been reported. However, there are many unknown aspects of actinomycetes since a number of genes have not been identified so far.

These unknown points can be clarified by the following method.

The functional information of ORF derived from actinomycetes as identified by the method of above item 2 is arranged. The term "arranged" means that the ORF is classified based on the biosynthesis pathway of a substance or the signal transmission pathway to which the ORF belongs using known information according to the functional information. Next, the arranged ORF sequence information is compared with enzymes on the biosynthesis pathways or signal transmission pathways of other known organisms. The resulting information is combined with known data on actinomycetes. Thus, the biosynthesis pathways and signal transmission pathways in actinomycetes, which have been unknown so far, can be determined.

As a result that these pathways which have been unknown or unclear hitherto are clarified, a useful mutant for producing a target useful substance can be efficiently obtained.

When the thus clarified pathway is judged as important in the synthesis of a useful product, a useful mutant can be obtained by selecting a mutant wherein this pathway has been strengthened. Also, when the thus clarified pathway is judged as not important in the biosynthesis of the target useful product, a useful mutant can be obtained by selecting a mutant wherein the utilization frequency of this pathway is lowered.

5. Clarification or Determination of Useful Mutation Point

Many useful mutants of actinomycetes which are suitable for the production of useful substances, such as biological active substances comprising an antibiotic, and the like, have been obtained. However, it is hardly known which mutation point is imparted to a gene to improve the productivity.

However, mutation points contained in production strains can be identified by comparing desired sequences of the genome DNA of the production strains obtained from actinomycetes by the mutagenic technique with the nucleotide sequences of the corresponding genome DNA and ORF derived from actinomycetes determined by the methods of the above items 1 and 2 and analyzing them Moreover, effective mutation points contributing to the production can be easily specified from among these mutation points on the basis of known information relating to the metabolic pathways, the metabolic regulatory mechanisms, the structure activity correlation of enzymes, and the like.

When any efficient mutation can be hardly specified based on known data, the mutation points thus identified can be introduced into a wild strain of actinomycetes or a production strain free of the mutation. Then, it is examined whether or not any positive effect can be achieved on the production.

6. Method of Breeding Industrially Advantageous Production Strain

It has been a general practice to construct production strains, which are used industrially in the fermentation production of the target useful substances, such as biological active substances comprising an antibiotic, and the like, by repeating mutagenesis and breeding based on random mutagenesis using mutagens, such as NTG or the like, and screening.

Although mutagenesis methods have largely contributed to the progress of the fermentation industry, they suffer from a serious problem of multiple, random introduction of mutations into every part of the chromosome. Since many mutations are accumulated in a single chromosome each time a strain is improved, a production strain obtained by the random mutation and selecting is generally inferior in properties (for example, showing poor growth, delayed consumption of saccharides, and poor resistance to stresses such as temperature and oxygen) to a wild type strain, which brings about troubles such as failing to establish a sufficiently elevated productivity, being frequently contaminated with miscellaneous bacteria, requiring troublesome procedures in culture maintenance, and the like, and, in its turn, elevating the production cost in practice. In addition, the improvement in the productivity is based on random mutations and thus the mechanism thereof is unclear. Therefore, it is very difficult to plan a rational breeding strategy for the subsequent improvement in the productivity.

According to the present invention, effective mutation points contributing to the production can be efficiently specified from among many mutation points accumulated in the chromosome of a production strain which has been bred from actinomycetes and, therefore, a novel breeding method of assembling these effective mutations in the actinomycetes can be established. Thus, a useful production strain can be reconstructed. It is also possible to construct a useful production strain from a wild type strain.

Specifically, a useful mutant can be constructed in the following manner.

One of the mutation points is incorporated into a wild type strain of actinomycetes. Then, it is examined whether or not a positive effect is established on the production. When a positive effect is obtained, the mutation point is saved. When no effect is obtained, the mutation point is removed. Subsequently, only a strain having the effective mutation point is used as the parent strain, and the same procedure is repeated. In general, the effectiveness of a mutation positioned upstream cannot be clearly evaluated in some cases when there is a rate-determining point in the downstream of a biosynthesis pathway. It is therefore preferred to successively evaluate mutation points upward from downstream.

By reconstituting effective mutations by the method as described above in a wild type strain or a strain which has a high growth speed or the same ability to consume saccharides as the wild type strain, it is possible to construct an industrially advantageous strain which is free of troubles in the previous methods as described above and to conduct fermentation production using such strains within a short time or at a higher temperature.

A strain having a further improved productivity of the target product can be obtained using the thus reconstructed strain as the parent strain and further breeding it using the conventional mutagenesis method, the gene amplification method, the gene replacement method using the recombinant DNA technique, the transduction method or the cell fusion method. Accordingly, the microorganism of the present invention includes, but is not limited to, a mutant, a cell fusion strain, a transformant, a transductant or a recombinant strain constructed by using recombinant DNA techniques, so long as it is a producing strain obtained via the step of accumulating at least two effective mutations in a actinomycetes in the course of breeding.

When a mutation point judged as being harmful to the growth or production is specified, on the other hand, it is examined whether or not the producing strain used at present contains the mutation point. When it has the mutation, it can be returned to the wild type gene and thus a further useful production strain can be bred.

The breeding method as described above is applicable to microorganisms, other than actinomycetes, which have industrially advantageous properties (for example, microorganisms capable of quickly utilizing less expensive carbon sources, microorganisms capable of growing at higher temperatures).

7. Production and Utilization of Polynucleotide Array (1) Production of Polynucleotide Array A polynucleotide array can be produced using the polynucleotide or oligonucleotide of the present invention obtained in the above items 1 and 2.

Examples include a polynucleotide array comprising a solid support to which at least one of a polynucleotide comprising the nucleotide sequence represented by SEQ ID NOs:2 to 7551, a polynucleotide which hybridizes with the polynucleotide under stringent conditions, and a polynucleotide comprising 10 to 200 continuous nucleotides in the nucleotide sequence of the polynucleotide is adhered; and a polynucleotide array comprising a solid support to which at least one of a polynucleotide encoding a polypeptide comprising the amino acid sequence represented by any one of SEQ ID NOs:7552 to 15101, a polynucleotide which hybridizes with the polynucleotide under stringent conditions, and a polynucleotide comprising 10 to 200 continuous bases in the nucleotide sequences of the polynucleotides is adhered.

Polynucleotide arrays of the present invention include substrates known in the art, such as a DNA chip, a DNA microarray and a DNA macroarray, and the like, and comprises a solid support and plural polynucleotides or fragments thereof which are adhered to the surface of the solid support.

Examples of the solid support include a glass plate, a nylon membrane, and the like.

The polynucleotides or fragments thereof adhered to the surface of the solid support can be adhered to the surface of the solid support using the general technique for preparing arrays. Namely, a method in which they are adhered to a chemically surface-treated solid support, for example, to which a polycation such as polylysine or the like has been adhered (*Nat. Genet.*, 21: 15-19 (1999)). The chemically surface-treated supports are commercially available and the commercially available solid product can be used as the solid support of the polynucleotide array according to the present invention.

As the polynucleotides or oligonucleotides adhered to the solid support, the polynucleotides and oligonucleotides of the present invention obtained in the above items 1 and 2 can be used.

The analysis described below can be efficiently performed by adhering the polynucleotides or oligonucleotides to the solid support at a high density, though a high fixation density is not always necessary.

Apparatus for achieving a high fixation density, such as an arrayer robot or the like, is commercially available from Takara Shuzo (GMS417 Arrayer), and the commercially available product can be used.

Also, the oligonucleotides of the present invention can be synthesized directly on the solid support by the photolithography method or the like (*Nat. Genet.*, 21: 20-24 (1999)). In this method, a linker having a protective group which can be removed by light irradiation is first adhered to a solid support, such as a slide glass or the like. Then, it is irradiated with light through a mask (a photolithograph mask) permeating light exclusively at a definite part of the adhesion part. Next, an oligonucleotide having a protective group which can be removed by light irradiation is added to the part. Thus, a ligation reaction with the nucleotide arises exclusively at the irradiated part. By repeating this procedure, oligonucleotides, each having a desired sequence, different from each other can be synthesized in respective parts. Usually, the oligonucleotides to be synthesized have a length of 10 to 30 nucleotides.

(2) Use of Polynucleotide Array

The following procedures (a) and (b) can be carried out using the polynucleotide array prepared in the above (1).

(a) Identification of Mutation Point of Actinomycetes Mutant and Analysis of Expression Amount and Expression Profile of Gene Encoded by Genome By subjecting a gene derived from a mutant of actinomycetes or an examined gene td the following steps (i) to (iv), the mutation point of the gene can be identified or the expression amount and expression profile of the gene can be analyzed:

(i) producing a polynucleotide array by the method of the above (1);
(ii) incubating polynucleotides immobilized on the polynucleotide array together with the labeled gene derived from a mutant of the actinomycetes using the polynucleotide array produced in the above (i) under hybridization conditions;
(iii) detecting the hybridization; and
(iv) analyzing the hybridization data.

The gene derived from a mutant of actinomycetes or the examined gene include a gene relating to biosynthesis of at least one selected from amino acids, nucleic acids, vitamins, saccharides, organic acids, antibiotics, and analogues thereof.

The method will be described in detail.

A single nucleotide polymorphism (SNP) in a human region of 2,300 kb has been identified using polynucleotide arrays (*Science*, 280: 1077-82 (1998)). In accordance with the method of identifying SNP and methods described in *Science*, 278: 680-686 (1997); *Proc. Natl. Acad. Sci. USA*, 96: 12833-38 (1999); *Science*, 284: 1520-23 (1999), and the like using the polynucleotide array produced in the above (1) and a nucleic acid molecule (DNA, RNA) derived from actinomycetes in the method of the hybridization, a mutation point of a useful mutant, which is useful in producing an amino acid, a nucleic acid, a vitamin, a saccharide, an organic acid, or the like can be identified and the gene expression amount and the expression profile thereof can be analyzed.

The nucleic acid molecule (DNA, RNA) derived from the actinomycetes can be obtained according to the general method described in *Molecular Cloning*, 2nd ed. or the like. Although ribosomal RNA (rRNA) is usually obtained in large excess in addition to the target mRNA, the analysis is not seriously disturbed thereby.

The resulting nucleic acid molecule derived from actinomycetes is labeled. Labeling can be carried out according to a method using a fluorescent dye, a method using a radioisotope or the like.

Specific examples include a labeling method in which psoralen-biotin is crosslinked with RNA extracted from a microorganism and, after hybridization reaction, a fluorescent dye having streptoavidin bound thereto is bound to the biotin moiety (*Nat. Biotechnol.*, 16: 45-48 (1998)); a labeling method in which a reverse transcription reaction is carried out using RNA extracted from a microorganism as a template and random primers as primers, and dUTP having a fluorescent dye (for example, Cy3, Cy5) (manufactured by Amersham Pharmacia Biotech) is incorporated into cDNA (*Proc. Natl. Acad. Sci. USA*, 96: 12833-38 (1999)); and the like.

The labeling specificity can be improved by replacing the random primers by sequences complementary to the 3'-end of ORF (*J. Bacteriol.*, 181: 6425-40 (1999)).

In the hybridization method, the hybridization and subsequent washing can be carried out by the general method (*Nat. Bioctechnol.*, 14: 1675-80 (1996), or the like).

Subsequently, the hybridization intensity is measured depending on the hybridization amount of the nucleic acid molecule used in the labeling. Thus, the mutation point can be identified and the expression amount of the gene can be calculated.

The hybridization intensity can be measured by visualizing the fluorescent signal, radioactivity, luminescence dose, and the like, using a laser confocal microscope, a CCD camera, a radiation imaging device (for example, STORM manufactured by Amersham Pharmacia Biotech), and the like, and then quantifying the thus visualized data.

A polynucleotide array on a solid support can also be analyzed and quantified using a commercially available apparatus, such as GMS418 Array Scanner (manufactured by Takara Shuzo) or the like.

The gene expression amount can be analyzed using a commercially available software (for example, ImaGene manufactured by Takara Shuzo; Array Gauge manufactured by Fuji Photo Film; ImageQuant manufactured by Amersham Pharmacia Biotech, or the like). A fluctuation in the expression amount of a specific gene can be monitored using a nucleic acid molecule obtained in the time course of culture as the nucleic acid molecule derived from actinomycetes. The culture conditions can be optimized by analyzing the fluctuation.

The expression profile of the microorganism at the total gene level (namely, which genes among a great number of genes encoded by the genome have been expressed and the expression ratio thereof) can be determined using a nucleic acid molecule having the sequences of many genes determined from the full genome sequence of the microorganism. Thus, the expression amount of the genes determined by the full genome sequence can be analyzed and, in its turn, the biological conditions of the microorganism can be recognized as the expression pattern at the full gene level.

(b) Confirmation of the Presence of Gene Homologous to Examined Gene in Actinomycetes Whether or not a gene homologous to the examined gene, which is present in an organism other than actinomycetes, is present in actinomycetes can be detected using the polynucleotide array prepared in the above (1).

This detection can be carried out by a method in which an examined gene which is present in an organism other than actinomycetes is used instead of the nucleic acid molecule derived from actinomycetes used in the above identification/analysis method of (1).

8. Recording Medium Storing Full Genome Nucleotide Sequence and ORF Data and Being Readable by a Computer and Methods for Using the Same The term "recording medium or storage device which is readable by a computer" means a recording medium or storage medium which can be directly readout and accessed with a computer. Examples include magnetic recording media, such as a floppy disk, a hard disk, a magnetic tape, and the like; optical recording media, such as CD-ROM, CD-R, CD-RW, DVD-ROM, DVD-RAM, DVD-RW, and the like; electric recording media, such as RAM, ROM, and the like; and hybrids in these categories (for example, magnetic/optical recording media, such as MO and the like).

Instruments for recording or inputting in or on the recording medium or instruments or devices for reading out the information in the recording medium can be appropriately selected, depending on the type of the recording medium and the access device utilized. Also, various data processing programs, software, comparator and formats are used for recording and utilizing the polynucleotide sequence information or the like. of the present invention in the recording medium. The information can be expressed in the form of a binary file, a text file or an ASCII file formatted with commercially available software, for example. Moreover, software for accessing the sequence information is available and known to one of ordinary skill in the art.

Examples of the information to be recorded in the above-described medium include the full genome nucleotide sequence information of actinomycetes as obtained in the above item 2, the nucleotide sequence information of ORF, the amino acid sequence information encoded by the ORF, and the functional information of polynucleotides coding for the amino acid sequences.

The recording medium or storage device which is readable by a computer according to the present invention refers to a medium in which the information of the present invention has been recorded. Examples include recording media or storage devices which are readable by a computer storing the nucleotide sequence information represented by SEQ ID NOs:1 to 7551, the amino acid sequence information represented by SEQ ID NOs:7552 to 15101, the functional information of the nucleotide sequences represented by SEQ ID NOs:1 to 7551, and the functional information of the amino acid sequences represented by SEQ ID NOs:7552 to 15101.

9. System Based on a Computer Using the Recording Medium of the Present Invention Which is Readable by a Computer The term "system based on a computer" as used herein refers a system composed of hardware device(s), software device(s), and data recording device(s) which are used for analyzing the data recorded in the recording medium of the present invention which is readable by a computer.

The hardware device(s) are, for example, composed of an input unit, a data recording unit, a central processing unit and an output unit collectively or individually.

By the software device(s), the data recorded in the recording medium of the present invention are searched or analyzed using the recorded data and the hardware device(s) as described herein. Specifically, the software device(s) contain at least one program which acts on or with the system in order to screen, analyze or compare biologically meaningful structures or information from the nucleotide sequences, amino acid sequences and the like recorded in the recording medium according to the present invention.

Examples of the software device(s) for identifying ORF and EMF domains include GeneMark (*Nuc. Acids. Res.,* 22: 4756-67 (1994)), GeneHacker (*Protein, Nucleic Acid and Enzyme,* 42: 3001-07 (1997)), Glimmer (The Institute of Genomic Research; *Nuc. Acids. Res.,* 26: 544-548 (1998)) and the like. In the process of using such a software device, the default (initial setting) parameters are usually used, although the parameters can be changed, if necessary, in a manner known to one of ordinary skill in the art.

Examples of the software device(s) for identifying a genome domain or a polypeptide domain analogous to the target sequence or the target structural motif (homology searching) include FASTA, BLAST, Smith-Waterman, GenetyxMac (manufactured by Software Development), GCG Package (manufactured by Genetic Computer Group), GenCore (manufactured by Compugen), and the like. In the process of using such a software device, the default (initial setting) parameters are usually used, although the parameters can be changed, if necessary, in a manner known to one of ordinary skill in the art.

Such a recording medium storing the full genome sequence data is useful in preparing a polynucleotide array by which the expression amount of a gene encoded by the genome DNA of actinomycetes and the expression profile at the total gene level of the microorganism, namely, which genes among many genes encoded by the genome have been expressed and the expression ratio thereof, can be determined.

The data recording device(s) provided by the present invention are, for example, memory device(s) for recording the data recorded in the recording medium of the present invention and target sequence or target structural motif data, or the like, and a memory accessing device(s) for accessing the same.

Namely, the system based on a computer according to the present invention comprises the following:

(i) a user input device that inputs the information stored in the recording medium of the present invention, and target sequence or target structure motif information;

(ii) a data storage device for at least temporarily storing the input information;

(iii) a comparator that compares the information stored in the recording medium of the present invention with the target sequence or target structure motif information, recorded by the data storing device of (ii) for screening and analyzing nucleotide sequence information which is coincident with or analogous to the target sequence or target structure motif information; and (iv) an output device that shows a screening or analyzing result obtained by the comparator.

This system is usable in the methods in items 2 to 5 as described above for searching and analyzing the ORF and EMF domains, target sequence, target structural motif, etc. of an actinomycetes, searching homologs, searching and analyzing isozymes, determining the biosynthesis pathway and the signal transmission pathway, and identifying spots which have been found in the proteome analysis. The term "homologs" as used herein includes both of orthologs and paralogs.

10. Production of Polypeptide Using ORF Derived from Actinomycetes

The polypeptide of the present invention can be produced using a polynucleotide comprising the ORF obtained in the above item 2. Specifically, the polypeptide of the present invention can be produced by expressing the polynucleotide of the present invention or a fragment thereof in a host cell, using the method described in *Molecular Cloning*, 2nd ed., *Current Protocols in Molecular Biology*, and the like, for example, according to the following method.

A DNA fragment having a suitable length containing a part encoding the polypeptide is prepared from the full length ORF sequence, if necessary.

Also, DNA in which nucleotides in a nucleotide sequence at a part encoding the polypeptide of the present invention are replaced to give a codon suitable for expression of the host cell, if necessary. The DNA is useful for efficiently producing the polypeptide of the present invention.

A recombinant vector is prepared by inserting the DNA fragment into the downstream of a promoter in a suitable expression vector.

The recombinant vector is introduced to a host cell suitable for the expression vector.

Any of bacteria, yeasts, animal cells, insect cells, plant cells, and the like can be used as the host cell so long as it can be expressed in the gene of interest.

Examples of the expression vector include those which can replicate autonomously in the above-described host cell or can be integrated into chromosome and have a promoter at such a position that the DNA encoding the polypeptide of the present invention can be transcribed.

When a prokaryote cell, such as a bacterium or the like, is used as the host cell, it is preferred that the recombinant vector containing the DNA encoding the polypeptide of the present invention can replicate autonomously in the bacterium and is a recombinant vector constituted by, at least a promoter, a ribosome binding sequence, the DNA of the present invention and a transcription termination sequence. A promoter controlling gene can also be contained therewith in operable combination.

Examples of the expression vectors include a vector plasmid which is replicable in *Streptomyces avermitilis*, such as pIJ6021 and the like; a vector plasmid which is replicable in *Escherichia coli*, such as pET3 and pET11 (manufactured by Stratagene), pBAD, pThioBis and pTrcHis (manufactured by Invitrogen), pKK223-3 and pGEX2T (manufactured by Amersham Pharmacia Biotech), and the like; and pBTrp2, pBTac1 and pBTac2 (manufactured by Boehringer Mannheim Co.), pSE280 (manufactured by Invitrogen), pGE-MEX-1 (manufactured by Promega), pQE-8 (manufactured by QIAGEN), pGEL1 (*Proc. Natl. Acad. Sci. USA*, 82: 4306 (1985)), pBluescript II SK(–) (manufactured by Stratagene), psupex, pUB110, pTP5, pC194 and pEG400 (*J. Bacteriol.*, 172: 2392 (1990)), pGEX (manufactured by Pharmacia), pET system (manufactured by Novagen), and the like.

Any promoter can be used so long as it can function in the host cell. Examples include promoters derived from *Escherichia coli*, phage and the like, such as trp promoter ($P_{trp}$), lac promoter, $P_L$ promoter, $P_R$ promoter, T7 promoter and the like. Also, artificially designed and modified promoters, such as a promoter in which two Ptrp are linked in series ($P_{trp} \times 2$), tac promoter, lacT7 promoter, letI promoter and the like, can be used.

It is preferred to use a plasmid in which the space between Shine-Dalgarno sequence which is the ribosome binding sequence and the initiation codon is adjusted to an appropriate distance (for example, 6 to 18 nucleotides).

The transcription termination sequence is not always necessary for the expression of the DNA of the present invention. However, it is preferred to arrange the transcription terminating sequence at just downstream of the structural gene. One of ordinary skill in the art will appreciate that the codons of the above-described elements may be optimized, in a known manner, depending on the host cells and environmental conditions utilized.

Examples of the host cell include microorganisms belonging to the genus *Escherichia*, the genus *Serratia*, the genus *Bacillus*, the genus *Brevibacterium*, the genus *Corynebacterium*, the genus *Microbacterium*, the genus *Pseudomonas*, the genus *Streptomyces*, the genus *Streptosporangium*, the genus *Amycolatopsis*, the genus *Actinoplanes*, the genus *Nocardioides*, the genus *Pseudonocardia*, the genus *Actinobispora*, the genus *Saccharomonospora*, the genus *Saccharopolyspora*, the genus *Saccharothrix*, the genus *Actinopolyspora*, the genus *Actinomadura*, the genus *Microbispora*, the genus *Microtetraspora*, the genus *Thermomonospora*, the genus *Micromonospora*, and the like. Specific examples include *Escherichia coli* XL1-Blue, *Escherichia coli* XL2-Blue, *Escherichia coli* DH1, *Escherichia coli* MC1000, *Escherichia coli* KY3276, *Escherichia coli* W1485, *Escherichia coli* JM109, *Escherichia coli* HB101, *Escherichia coli* W3110, *Bacillus subtilis*, *Bacillus amyloliquefacines*, *Streptomyces avermitilis*, *Streptomyces griseus*, *Streptomyces hygroscopicus*, *Streptomyces coelicolor*, *Streptomyces lividans*, and the like.

When *Streptomyces avermitilis* or an analogous microorganism is used as a host, an EMF necessary for expressing the polypeptide is not always contained in the vector so long as the polynucleotide of the present invention contains an EMF. When the EMF is not contained in the polynucleotide, it is necessary to prepare the EMF separately and ligate it so as to be in operable combination. Also, when a higher expression amount or specific expression regulation is necessary, it is necessary to ligate the EMF corresponding thereto so as to put the EMF in operable combination with the polynucleotide.

With regard to the method for the introduction of the recombinant vector, any method for introducing DNA into the above-described host cells, such as a method in which a calcium ion is used (*Proc. Natl. Acad. Sci. USA*, 69: 2110 (1972)), a protoplast method (Nature), and the like, can be used. When yeast is used as the host cell, examples of the expression vector include pYES2 (manufactured by Invitrogen), YEp13 (ATCC 37115), YEp24 (ATCC 37051), YCp50 (ATCC 37419), pHS19, pHS15, and the like.

Any promoter can be used so long as it can be expressed in yeast. Examples include a promoter of a gene in the glycolytic pathway, such as hexose kinase and the like, PHO5 promoter, PGK promoter, GAP promoter, ADH promoter, gal 1 promoter, gal 10 promoter, a heat shock protein promoter, MF α1 promoter, CUP 1 promoter, and the like.

Examples of the host cell include microorganisms belonging to the genus *Saccharomyces*, the genus *Schizosaccharomyces*, the genus *Kluyveromyces*, the genus *Trichosporon*, the genus *Schwanniomyces*, the genus *Pichia*, the genus *Candida* and the like. Specific examples include *Saccharomyces cerevisiae*, *Schizosaccharomyces pombe*, *Kluyveromyces lactis*, *Trichosporon pullulans*, *Schwanniomyces alluvius*, *Candida utilis* and the like.

With regard to the method for the introduction of the recombinant vector, any method for introducing DNA into yeast, such as electroporation (*Methods. Enzymol.*, 194: 182 (1990)), a spheroplast method (*Proc. Natl. Acad. Sci. USA*, 75: 1929 (1978)), a lithium acetate method (*J. Bacteriol.*, 153:

163 (1983)), a method described in *Proc. Natl. Acad. Sci. USA*, 75: 1929 (1978) and the like, can be used.

When animal cells are used as the host cells, examples of the expression vector include pcDNA3.1, pSinRep5 and pCEP4 (manufactured by Invitorogen), pRev-Tre (manufactured by Clontech), pAxCAwt (manufactured by Takara Shuzo), pcDNAI and pcDM8 (manufactured by Funakoshi), pAGE107 (Japanese Published Unexamined Patent Application No. 22979/91; *Cytotechnology*, 3:133 (1990)), pAS3-3 (Japanese Published Unexamined Patent Application No. 227075/90), pcDM8 (*Nature*, 329: 840 (1987)), pcDNAI/Amp (manufactured by Invitrogen), pREP4 (manufactured by Invitrogen), pAGE103 (*J. Biochem.*, 101: 1307 (1987)), pAGE210, and the like.

Any promoter can be used so long as it can function in animal cells. Examples include a promoter of IE (immediate early) gene of cytomegalovirus (CMV), an early promoter of SV40, a promoter of retrovirus, a metallothionein promoter, a heat shock promoter, SRα promoter, and the like. Also, the enhancer of the IE gene of human CMV can be used together with the promoter.

Examples of the host cell include human Namalwa cell, monkey COS cell, Chinese hamster CHO cell, HST5637 (Japanese Published Unexamined Patent Application No. 299/88), and the like.

The method for introduction of the recombinant vector into animal cells is not particularly limited, so long as it is the general method for introducing DNA into animal cells, such as an electroporation method (*Cytotechnology*, 3: 133 (1990)), a calcium phosphate method (Japanese Published Unexamined Patent Application No. 227075/90), a lipofection method (*Proc. Natl. Acad. Sci. USA*, 84, 7413 (1987)), the method described in *Virology*, 52: 456 (1973), and the like.

When insect cells are used as the host cells, the polypeptide can be expressed, for example, by the method described in Bacurovirus Expression Vectors, A Laboratory Manual, W. H. Freeman and Company, New York (1992), Bio/Technology, 6: 47 (1988), or the like.

Specifically, a recombinant gene transfer vector and bacurovirus are simultaneously inserted into insect cells to obtain a recombinant virus in an insect cell culture supernatant, and then the insect cells are infected with the resulting recombinant virus to express the polypeptide.

Examples of the gene introducing vector used in the method include pBlueBac4.5, pVL1392, pVL1393 and pBlueBacIII (manufactured by Invitrogen), and the like.

Examples of the bacurovirus include *Autographa californica* nuclear polyhedrosis virus with which insects of the family Barathra are infected, and the like.

Examples of the insect cells include *Spodoptera frugiperda* oocytes Sf9 and Sf21 (Bacurovirus Expression Vectors, A Laboratory Manual, W. B. Freeman and Company, New York (1992)), *Trichoplusia ni* oocyte High 5 (manufactured by Invitrogen) and the like.

The method for simultaneously incorporating the above-described recombinant gene transfer vector and the above-described bacurovirus for the preparation of the recombinant virus include calcium phosphate method (Japanese Published Unexamined Patent Application No. 227075/90), lipofection method (*Proc. Natl. Acad. Sci. USA*, 84: 7413 (1987)) and the like.

When plant cells are used as the host cells, examples of expression vector include a Ti plasmid, a tobacco mosaic virus vector, and the like.

Any promoter can be used so long as it can be expressed in plant cells. Examples include 35S promoter of cauliflower mosaic virus (CaMV), rice actin 1 promoter, and the like.

Examples of the host cells include plant cells and the like, such as tobacco, potato, tomato, carrot, soybean, rape, alfalfa, rice, wheat, barley, and the like.

The method for introducing the recombinant vector is not particularly limited, so long as it is the general method for introducing DNA into plant cells, such as the *Agrobacterium* method (Japanese Published Unexamined Patent Application No. 140885/84, Japanese Published Unexamined Patent Application No. 70080/85, WO 94/00977), the electroporation method (Japanese Published Unexamined Patent Application No. 251887/85), the particle gun method (Japanese Patents 2606856 and 2517813), and the like.

The transformant of the present invention includes a transformant containing the polypeptide of the present invention per se rather than as a recombinant vector, that is, a transformant containing the polypeptide of the present invention which is integrated into a chromosome of the host, in addition to the transformant containing the above recombinant vector.

When expressed in yeasts, animal cells, insect cells or plant cells, a glycopolypeptide or glycosylated polypeptide can be obtained.

The polypeptide can be produced by culturing the thus obtained transformant of the present invention in a culture medium to produce and accumulate the polypeptide of the present invention or any polypeptide expressed under the control of an EMF of the present invention, and recovering the polypeptide from the culture.

Culturing of the transformant of the present invention in a culture medium is carried out according to the conventional method as used in culturing of the host.

When the transformant of the present invention is obtained using a prokaryote, such as *Escherichia coli* or the like, or a eukaryote, such as yeast or the like, as the host, the transformant is cultured.

Any of a natural medium and a synthetic medium can be used, so long as it contains a carbon source, a nitrogen source, an inorganic salt and the like which can be assimilated by the transformant and can perform culturing of the transformant efficiently.

Examples of the carbon source include those which can be assimilated by the transformant, such as carbohydrates (for example, glucose, fructose, sucrose, molasses containing them, starch, starch hydrolysate, and the like), organic acids (for example, acetic acid, propionic acid, and the like), and alcohols (for example, ethanol, propanol, and the like).

Examples of the nitrogen source include ammonia, various ammonium salts of inorganic acids or organic acids (for example, ammonium chloride, ammonium sulfate, ammonium acetate, ammonium phosphate, and the like), other nitrogen-containing compounds, peptone, meat extract, yeast extract, corn steep liquor, casein hydrolysate, soybean meal and soybean meal hydrolysate, various fermented cells and hydrolysates thereof, and the like.

Examples of the inorganic salt include potassium dihydrogen phosphate, dipotassium hydrogen phosphate, magnesium phosphate, magnesium sulfate, sodium chloride, ferrous sulfate, manganese sulfate, copper sulfate, calcium carbonate, and the like. The culturing is carried out under aerobic conditions by shaking culture, submerged-aeration stirring culture or the like. The culturing temperature is preferably from 15 to 40° C., and the culturing time is generally from 16 hours to 7 days. The pH of the medium is preferably maintained at 3.0 to 9.0 during the culturing. The pH can be adjusted using an inorganic or organic acid, an alkali solution, urea, calcium carbonate, ammonia, or the like.

Also, antibiotics, such as ampicillin, tetracycline, and the like, can be added to the medium during the culturing, if necessary.

When a microorganism transformed with a recombinant vector containing an inducible promoter is cultured, an inducer can be added to the medium, if necessary. For example, isopropyl-β-D-thiogalactopyranoside (IPTG) or the like can be added to the medium when a microorganism transformed with a recombinant vector containing lac promoter is cultured, or indoleacrylic acid (IAA) or the like can by added thereto when a microorganism transformed with an expression vector containing trp promoter is cultured.

Examples of the medium used in culturing a transformant obtained using animal cells as the host cells include RPMI 1640 medium (*The Journal of the American Medical Association*, 199: 519 (1967)), Eagle's MEM medium (*Science*, 122: 501 (1952)), Dulbecco's modified MEM medium (*Virology*, 8: 396 (1959)), 199 Medium (*Proceeding of the Society for the Biological Medicine*, 73: 1 (1950)), the above-described media to which fetal calf serum has been added, and the like.

The culturing is carried out generally at a pH of 6 to 8 and a temperature of 30 to 40° C. in the presence of 5% $CO_2$ for 1 to 7 days.

Also, if necessary, antibiotics, such as kanamycin, penicillin, and the like, can be added to the medium during the culturing.

Examples of the medium used in culturing a transformant obtained using insect cells as the host cells include TNM-FH medium (manufactured by Pharmingen), Sf-900 II SFM (manufactured by Life Technologies), ExCell 400 and ExCell 405 (manufactured by JRH Biosciences), Grace's Insect Medium (*Nature*, 195: 788 (1962)), and the like.

The culturing is carried out generally at a pH of 6 to 7 and a temperature of 25 to 30° C. for 1 to 5 days.

Additionally, antibiotics, such as gentamicin and the like, can be added to the medium during the culturing, if necessary.

A transformant obtained by using a plant cell as the host cell can be used as the cell or after differentiating to a plant cell or organ. Examples of the medium used in the culturing of the transformant include Murashige and Skoog (MS) medium, White medium, media to which a plant hormone, such as auxin, cytokinine, or the like has been added, and the like.

The culturing is carried out generally at a pH of 5 to 9 and a temperature of 20 to 40° C. for 3 to 60 days.

Also, antibiotics, such as kanamycin, hygromycin and the like, can be added to the medium during the culturing, if necessary.

As described above, the polypeptide can be produced by culturing a transformant derived from a microorganism, animal cell or plant cell containing a recombinant vector to which a DNA encoding the polypeptide of the present invention has been inserted according to the general culturing method to produce and accumulate the polypeptide, and recovering the polypeptide from the culture.

The process of gene expression may include secretion of the encoded protein production or fusion protein expression and the like in accordance with the methods described in *Molecular Cloning*, 2nd ed., in addition to direct expression.

The method for producing the polypeptide of the present invention includes a method of intracellular expression in a host cell, a method of extracellular secretion from a host cell, or a method of production on a host cell membrane outer envelope. The method can be selected by changing the host cell employed or the structure of the polypeptide produced.

When the polypeptide of the present invention is produced in a host cell or on a host cell membrane outer envelope, the polypeptide can be positively secreted extracellularly according to, for example, the method of Paulson et al. (*J. Biol. Chem.*, 264: 17619 (1989)), the method of Lowe et al. (*Proc. Natl. Acad. Sci. USA*, 86: 8227 (1989); *Genes Develop.*, 4: 1288 (1990)), and/or the methods described in Japanese Published Unexamined Patent Application No. 336963/93, WO 94/23021, and the like.

Specifically, the polypeptide of the present invention can be positively secreted extracellularly by expressing it in the form that a signal peptide has been added to the foreground of a polypeptide containing an active site of the polypeptide of the present invention according to the recombinant DNA technique.

Furthermore, the amount produced can be increased using a gene amplification system, such as by use of a dihydrofolate reductase gene or the like according to the method described in Japanese Published Unexamined Patent Application No. 227075/90.

Moreover, the polypeptide of the present invention can be produced by a transgenic animal individual (transgenic nonhuman animal) or plant individual (transgenic plant).

When the transformant is the animal individual or plant individual, the polypeptide of the present invention can be produced by breeding or cultivating it so as to produce and accumulate the polypeptide, and recovering the polypeptide from the animal individual or plant individual.

Examples of the method for producing the polypeptide of the present invention using the animal individual include a method for producing the polypeptide of the present invention in an animal developed by inserting a gene according to methods known to those of ordinary skill in the art (*American Journal of Clinical Nutrition*, 63: 639S (1996), *American Journal of Clinical Nutrition*, 63: 627S (1996), *Bio/Technology*, 9: 830 (1991)).

In the animal individual, the polypeptide can be produced by breeding a transgenic nonhuman animal to which the DNA encoding the polypeptide of the present invention has been inserted to produce and accumulate the polypeptide in the animal, and recovering the polypeptide from the animal. Examples of the production and accumulation place in the animal include milk (Japanese Published Unexamined Patent Application No. 309192/88), egg and the like of the animal. Any promoter can be used, so long as it can be expressed in the animal. Suitable examples include an α-casein promoter, a β-casein promoter, a β-lactoglobulin promoter, a whey acidic protein promoter, and the like, which are specific for mammary glandular cells.

Examples of the method for producing the polypeptide of the present invention using the plant individual include a method for producing the polypeptide of the present invention by cultivating a transgenic plant to which the DNA encoding the protein of the present invention by a known method (*Tissue Culture*, 20 (1994), *Tissue Culture*, 21 (1994), *Trends in Biotechnology*, 15: 45 (1997)) to produce and accumulate the polypeptide in the plant, and recovering the polypeptide from the plant.

The polypeptide according to the present invention can also be obtained by translation in vitro.

The polypeptide of the present invention can be produced by a translation system in vitro. There are, for example, two in vitro translation methods which may be used, namely, a method using RNA as a template and another method using DNA as a template. The template RNA includes the whole RNA, mRNA, an in vitro transcription product, and the like. The template DNA includes a plasmid containing a transcriptional promoter and a target gene integrated therein and downstream of the initiation site, a PCR/RT-PCR product and the like. To select the most suitable system for the in vitro translation, the origin of the gene encoding the protein to be synthesized (prokaryotic cell/eucaryotic cell), the type of the template (DNA/RNA), the purpose of using the synthesized protein and the like should be considered. In vitro translation kits having various characteristics are commercially available from many companies (Boehringer Mannheim, Promega, Stratagene, or the like), and every kit can be used in producing the polypeptide according to the present invention.

Transcription/translation of a DNA nucleotide sequence cloned into a plasmid containing a T7 promoter can be carried out using an in vitro transcription/translation system *Escherichia coli* T7 S30 Extract System for Circular DNA (manufactured by Promega, catalogue No. L1130). Also, transcription/translation using, as a template, a linear prokaryotic DNA of a supercoil non-sensitive promoter, such as lacUW5, tac, λPL(con), λPL, or the like, can be carried out using an in vitro transcription/translation system *Escherichia coli* S30 Extract System for Linear Templates (manufactured by Promega, catalogue No. L1030). Examples of the linear prokaryotic DNA used as a template include a DNA fragment, a PCR-amplified DNA product, a duplicated oligonucleotide ligation, an in vitro transcriptional RNA, a prokaryotic RNA, and the like.

In addition to the production of the polypeptide according to the present invention, synthesis of a radioactive labeled protein, confirmation of the expression capability of a cloned gene, analysis of the function of transcriptional reaction or translation reaction, and the like can be carried out using this system.

The polypeptide produced by the transformant of the present invention can be isolated and purified using the general method for isolating and purifying an enzyme. For example, when the polypeptide of the present invention is expressed as a soluble product in the host cells, the cells are collected by centrifugation after cultivation, suspended in an aqueous buffer, and disrupted using an ultrasonicator, a French press, a Manton Gaulin homogenizer, a Dynomill, or the like to obtain a cell-free extract. From the supernatant obtained by centrifuging the cell-free extract, a purified product can be obtained by the general method used for isolating and purifying an enzyme, for example, solvent extraction, salting out using ammonium sulfate or the like, desalting, precipitation using an organic solvent, anion exchange chromatography using a resin, such as diethylaminoethyl (DEAE)-Sepharose, DIAION HPA-75 (manufactured by Mitsubishi Chemical) or the like, cation exchange chromatography using a resin, such as S-Sepharose FF (manufactured by Pharmacia) or the like, hydrophobic chromatography using a resin, such as butyl sepharose, phenyl sepharose or the like, gel filtration using a molecular sieve, affinity chromatography, chromatofocusing, or electrophoresis, such as isoelectronic focusing or the like, alone or in combination thereof.

When the polypeptide is expressed as an insoluble product in the host cells, the cells are collected in the same manner, disrupted and centrifuged to recover the insoluble product of the polypeptide as the precipitate fraction. Next, the insoluble product of the polypeptide is solubilized with a protein denaturing agent. The solubilized solution is diluted or dialyzed to lower the concentration of the protein denaturing agent in the solution. Thus, the normal configuration of the polypeptide is reconstituted. After the procedure, a purified product of the polypeptide can be obtained by a purification/isolation method similar to the above.

When the polypeptide of the present invention or its derivative (for example, a polypeptide formed by adding a sugar chain thereto) is secreted out of cells, the polypeptide or its derivative can be collected in the culture supernatant. Namely, the culture supernatant is obtained by treating the culture medium in a treatment similar to the above (for example, centrifugation). Then, a purified product can be obtained from the culture medium using a purification/isolation method similar to the above.

The polypeptide obtained by the above method is within the scope of the polypeptide of the present invention, and examples include a polypeptide encoded by a polynucleotide comprising the nucleotide sequence selected from SEQ ID NOs:2 to 7551, and a polypeptide comprising an amino acid sequence represented by any one of SEQ ID NOs:7552 to 15101.

Furthermore, a polypeptide comprising an amino acid sequence in which at least one amino acids is deleted, replaced, inserted or added in the amino acid sequence of the polypeptide and having substantially the same activity as that of the polypeptide is included in the scope of the present invention. The term "substantially the same activity as that of the polypeptide" means the same activity represented by the inherent function, enzyme activity or the like possessed by the polypeptide which has not been deleted, replaced, inserted or added. The polypeptide can be obtained using a method for introducing part-specific mutations described in, for example, *Molecular Cloning*, 2nd ed., *Current Protocols in Molecular Biology, Nuc. Acids. Res.*, 10: 6487 (1982), *Proc. Natl. Acad. Sci. USA*, 79: 6409 (1982), *Gene*, 34: 315 (1985), *Nuc. Acids. Res.*, 13: 4431 (1985), *Proc. Natl. Acad. Sci. USA*, 82: 488 (1985) and the like. For example, the polypeptide can be obtained by introducing mutation(s) to DNA encoding a polypeptide having the amino acid sequence represented by any one of SEQ ID NOs:7552 to 15101. The number of the amino acids which are deleted, replaced, inserted or added is not particularly limited; however, it is usually 1 to the order of tens, preferably 1 to 20, more preferably 1 to 10, and most preferably 1 to 5, amino acids.

The at least one amino acid deletion, replacement, insertion or addition in the amino acid sequence of the polypeptide of the present invention is used herein to refer to that at least one amino acid is deleted, replaced, inserted or added to at one or plural positions in the amino acid sequence. The deletion, replacement, insertion or addition may be caused in the same amino acid sequence simultaneously. Also, the amino acid residue replaced, inserted or added can be natural or non-natural. Examples of the natural amino acid residue include L-alanine, L-asparagine, L-asparatic acid, L-glutamine, L-glutamic acid, glycine, L-histidine, L-isoleucine, L-leucine, L-lysine, L-methionine, L-phenylalanine, L-proline, L-serine, L-threonine, L-tryptophan, L-tyrosine, L-valine, L-cysteine, and the like.

Herein, examples of amino acid residues which are replaced with each other are shown below. The amino acid residues in the same group can be replaced with each other.

Group A:
leucine, isoleucine, norleucine, valine, norvaline, alanine, 2-aminobutanoic acid, methionine, O-methylserine, t-butylglycine, t-butylalanine, cyclohexylalanine;

Group B:
asparatic acid, glutamic acid, isoasparatic acid, isoglutamic acid, 2-aminoadipic acid, 2-aminosuberic acid;

Group C:
asparagine, glutamine;

Group D:
  lysine, arginine, ornithine, 2,4-diaminobutanoic acid, 2,3-diaminopropionic acid;

Group E:
  proline, 3-hydroxyproline, 4-hydroxyproline;

Group F:
  serine, threonine, homoserine;

Group G:
  phenylalanine, tyrosine.

Also, in order that the resulting mutant polypeptide has substantially the same activity as that of the polypeptide which has not been mutated, it is preferred that the mutant polypeptide has a homology of 60% or more, preferably 80% or more, and particularly preferably 95% or more, with the polypeptide which has not been mutated, when calculated, for example, using default (initial setting) parameters by a homology searching software, such as BLAST, FASTA, or the like.

Also, the polypeptide of the present invention can be produced by a chemical synthesis method, such as Fmoc (fluorenylmethyloxycarbonyl) method, tBoc (t-butyloxycarbonyl) method, or the like. It can also be synthesized using a peptide synthesizer manufactured by Advanced ChemTech, Perkin-Elmer, Pharmacia, Protein Technology Instrument, Synthecell-Vega, PerSeptive, Shimadzu Corporation, or the like.

The transformant of the present invention can be used for objects other than the production of the polypeptide of the present invention.

Specifically, at least one component selected from an amino acid, a nucleic acid, a vitamin, a saccharide, an organic acid, an antibiotic, and analogues thereof can be produced by culturing the transformant containing the polynucleotide or recombinant vector of the present invention in a medium to produce and accumulate at least one component selected from amino acids, nucleic acids, vitamins, saccharides, organic acids, antibiotics, and analogues thereof, and recovering the same from the medium.

The biosynthesis pathways, decomposition pathways and regulatory mechanisms of amino acids, nucleic acids, vitamins, saccharides, organic acids, and analogues thereof used for the production of biological active substances comprising an antibiotic differ from organism to organism. Furthermore, the biosynthesis pathways, decomposition pathways and regulatory mechanisms of biological active substances comprising an antibiotic and analogues thereof differ from organism to organism. The productivity of such a physiologically active substance can be improved using these differences, specifically by introducing a heterogeneous gene relating to the biosynthesis thereof.

To produce such a physiologically active substance, the transformant according to the present invention can be cultured by the same method as employed in culturing the transformant for producing the polypeptide of the present invention as described above. Also, the physiologically active substance can be recovered from the culture medium in combination with, for example, the ion exchange resin method, the precipitation method and other known methods.

Examples of methods known to one of ordinary skill in the art include electroporation, calcium transfection, the protoplast method, the method using a phage, and the like, when the host is a bacterium; and microinjection, calcium phosphate transfection, the positively charged lipid-mediated method and the method using a virus, and the like, when the host is a eukaryote (*Molecular Cloning*, 2nd ed.; Spector et al., *Cells/a laboratory manual*, Cold Spring Harbour Laboratory Press, 1998)). Examples of the host include prokaryotes, lower eukaryotes (for example, yeasts), higher eukaryotes (for example, mammals), and cells isolated therefrom. As the state of a recombinant polynucleotide fragment present in the host cells, it can be integrated into the chromosome of the host. Alternatively, it can be integrated into a factor (for example, a plasmid) having an independent replication unit outside the chromosome. These transformants are usable in producing the polypeptides of the present invention encoded by the ORF of the genome of *Streptomyces avermitilis*, the polynucleotides of the present invention and fragments thereof. Alternatively, they can be used in producing arbitrary polypeptides under the regulation by an EMF of the present invention.

11. Production of Antibody Recognizing the Polypeptide of the Present Invention

An antibody which recognizes the polypeptide of the present invention, such as a polyclonal antibody, a monoclonal antibody, or the like, can be produced using, as an antigen, a purified product of the polypeptide of the present invention or a partial fragment polypeptide of the polypeptide or a peptide having a partial amino acid sequence of the polypeptide of the present invention.

(1) Production of Polyclonal Antibody

A polyclonal antibody can be produced using, as an antigen, a purified product of the polypeptide of the present invention, a partial fragment polypeptide of the polypeptide, or a peptide having a partial amino acid sequence of the polypeptide of the present invention, and immunizing an animal with the same.

Examples of the animal to be immunized include a rabbit, a goat, a rat, a mouse, a hamster, a chicken and the like.

A dosage of the antigen is preferably 50 to 100 μg per animal.

When the peptide is used as the antigen, it is preferably a peptide covalently bonded to a carrier protein, such as keyhole limpet haemocyanin, bovine thyroglobulin, or the like. The peptide used as the antigen can be synthesized by a peptide synthesizer.

The administration of the antigen is, for example, carried out 3 to 10 times at the intervals of 1 or 2 weeks after the first administration. On the 3rd to 7th day after each administration, a blood sample is collected from the venous plexus of the eyeground, and it is confirmed that the serum reacts with the antigen by the enzyme immunoassay (*Enzyme-linked Immunosorbent Assay* (*ELISA*), Igaku Shoin (1976); *Antibodies—A Laboratory Manual*, Cold Spring Harbor Laboratory (1988)) or the like.

Serum is obtained from the immunized non-human mammal with a sufficient antibody titer against the antigen used for the immunization, and the serum is isolated and purified to obtain a polyclonal antibody.

Examples of the method for the isolation and purification include centrifugation, salting out by 40-50% saturated ammonium sulfate, caprylic acid precipitation (*Antibodies, A Laboratory manual*, Cold Spring Harbor Laboratory (1988)), or chromatography using a DEAE-Sepharose column, an anion exchange column, a protein A- or G-column, a gel filtration column, and the like, alone or in combination thereof, by methods known to those of ordinary skill in the art.

(2) Production of Monoclonal Antibody (a) Preparation of Antibody-Producing Cell A rat having a serum showing an enough antibody titer against a partial fragment polypeptide of the polypeptide of the present invention used for immunization is used as a supply source of an antibody-producing cell.

On the 3rd to 7th day after the antigen substance is finally administered the rat showing the antibody titer, the spleen is excised.

The spleen is cut to pieces in MEM medium (manufactured by Nissui Pharmaceutical), loosened using a pair of forceps, followed by centrifugation at 1,200 rpm for 5 minutes, and the resulting supernatant is discarded.

The spleen in the precipitated fraction is treated with a Tris-ammonium chloride buffer (pH 7.65) for 1 to 2 minutes to eliminate erythrocytes and washed three times with MEM medium, and the resulting spleen cells are used as antibody-producing cells.

(b) Preparation of Myeloma Cells

As myeloma cells, an established cell line obtained from mouse or rat is used. Examples of useful cell lines include those derived from a mouse, such as P3-X63Ag8-U1 (hereinafter referred to as "P3-U1") (*Curr. Topics in Microbiol. Immunol.*, 81: 1 (1978); *Europ. J. Immunol.*, 6: 511 (1976)); SP2/O-Ag14 (SP-2) (*Nature*, 276: 269 (1978)): P3-X63-Ag8653 (653) (*J. Immunol.*, 123: 1548 (1979)); P3-X63-Ag8 (X63) cell line (*Nature*, 256: 495 (1975)), and the like, which are 8-azaguanine-resistant mouse (BALB/c) myeloma cell lines. These cell lines are subcultured in 8-azaguanine medium (medium in which, to a medium obtained by adding 1.5 mmol/l glutamine, $5 \times 10^{-5}$ mol/l 2-mercaptoethanol, 10 μg/ml gentamicin and 10% fetal calf serum (FCS) (manufactured by CSL) to RPMI-1640 medium (hereinafter referred to as the "normal medium"), 8-azaguanine is further added at 15 μg/ml) and cultured in the normal medium 3 or 4 days before cell fusion, and $2 \times 10^7$ or more of the cells are used for the fusion.

(c) Production of Hybridoma

The antibody-producing cells obtained in (a) and the myeloma cells obtained in (b) are washed with MEM medium or PBS (disodium hydrogen phosphate: 1.83 g, sodium dihydrogen phosphate: 0.21 g, sodium chloride: 7.65 g, distilled water: 1 liter, pH: 7.2) and mixed to give a ratio of antibody-producing cells:myeloma cells=5:1 to 10:1, followed by centrifugation at 1,200 rpm for 5 minutes, and the supernatant is discarded.

The cells in the resulting precipitated fraction were thoroughly loosened, 0.2 to 1 ml of a mixed solution of 2 g of polyethylene glycol-1000 (PEG-1000), 2 ml of MEM medium and 0.7 ml of dimethylsulfoxide (DMSO) per $10^8$ antibody-producing cells is added to the cells under stirring at 37° C., and then 1 to 2 ml of MEM medium is further added thereto several times at 1 to 2 minute intervals.

After the addition, MEM medium is added to give a total amount of 50 ml. The resulting prepared solution is centrifuged at 900 rpm for 5 minutes, and then the supernatant is discarded. The cells in the resulting precipitated fraction were gently loosened and then gently suspended in 100 ml of HAT medium (the normal medium to which $10^{-4}$ mol/l hypoxanthine, $1.5 \times 10^{-5}$ mol/l thymidine and $4 \times 10^{-7}$ mol/l aminopterin have been added) by repeated drawing up into and discharging from a measuring pipette.

The suspension is poured into a 96 well culture plate at 100 μl/well and cultured at 37° C. for 7 to 14 days in a 5% $CO_2$ incubator.

After the culturing, a part of the culture supernatant is recovered, and a hybridoma which specifically reacts with a partial fragment polypeptide of the polypeptide of the present invention is selected according to the enzyme immunoassay described in *Antibodies, A Laboratory manual*, Cold Spring Harbor Laboratory, Chapter 14 (1998) and the like.

A specific example of the enzyme immunoassay is described below.

The partial fragment polypeptide of the polypeptide of the present invention used as the antigen in the immunization is spread on a suitable plate, is allowed to react with a hybridoma culturing supernatant or a purified antibody obtained in (d) described below as a first antibody, and is further allowed to react with an anti-rat or anti-mouse immunoglobulin antibody labeled with an enzyme, a chemical luminous substance, a radioactive substance or the like as a second antibody for reaction suitable for the labeled substance. A hybridoma which specifically reacts with the polypeptide of the present invention is selected as a hybridoma capable of producing a monoclonal antibody of the present invention.

Cloning is repeated using the hybridoma twice by limiting dilution analysis (HT medium (a medium in which aminopterin has been removed from HAT medium) is firstly used, and the normal medium is secondly used), and a hybridoma which is stable and contains a sufficient amount of antibody titer is selected as a hybridoma capable of producing a monoclonal antibody of the present invention.

(d) Production of Monoclonal Antibody

The monoclonal antibody-producing hybridoma cells obtained in (c) are injected intraperitoneally into 8- to 10-week-old mice or nude mice treated with pristane (intraperitoneal administration of 0.5 ml of 2,6,10,14-tetramethylpentadecane (pristane), followed by 2 weeks of feeding) at $5 \times 10^6$ to $20 \times 10^6$ cells/animal. The hybridoma causes ascites tumor in 10 to 21 days.

The ascitic fluid is collected from the mice or nude mice, and centrifuged to remove solid contents at 3000 rpm for 5 minutes.

A monoclonal antibody can be purified and isolated from the resulting supernatant according to the method similar to that used in the polyclonal antibody.

The subclass of the antibody can be determined using a mouse monoclonal antibody typing kit or a rat monoclonal antibody typing kit. The polypeptide amount can be determined by the Lowry method or by calculation based on the absorbance at 280 nm.

The antibody obtained in the above is within the scope of the antibody of the present invention.

The antibody can be used for the general assay using an antibody, such as a radioactive material labeled immunoassay (RIA), competitive binding assay, an immunotissue chemical staining method (ABC method, CSA method, etc.), immunoprecipitation, Western blotting, ELISA assay, and the like (An introduction to *Radioimmunoassay and Related Techniques*, Elsevier Science (1986); *Techniques in Immunocytochemistry*, Academic Press, Vol. 1 (1982), Vol. 2 (1983) & Vol. 3 (1985); *Practice and Theory of Enzyme Immunoassays*, Elsevier Science (1985); *Enzyme-linked Immunosorbent Assay (ELISA)*, Igaku Shoin (1976); *Antibodies–A Laboratory Manual*, Cold Spring Harbor laboratory (1988); *Monoclonal Antibody Experiment Manual*, Kodansha Scientific (1987); *Second Series Biochemical Experiment Course*, Vol. 5, Immunobiochemistry Research Method, Tokyo Kagaku Dojin (1986)).

The antibody of the present invention can be used as it is or after being labeled with a label.

Examples of the label include radioisotope, an affinity label (e.g., biotin, avidin, or the like), an enzyme label (e.g., horseradish peroxidase, alkaline phosphatase, or the like), a fluorescence label (e.g., FITC, rhodamine, or the like), a label using a rhodamine atom, (*J. Histochem. Cytochem.*, 18: 315 (1970); *Meth. Enzym.*, 62: 308 (1979); *Immunol.*, 109: 129 (1972); *J. Immunol., Meth.*, 13: 215 (1979)), and the like.

Expression of the polypeptide of the present invention, fluctuation of the expression, the presence or absence of structural change of the polypeptide, and the presence or absence in an organism other than actinomycetes of a polypeptide corresponding to the polypeptide can be analyzed using the antibody or the labeled antibody by the above assay, or a polypeptide array or proteome analysis described below.

Furthermore, the polypeptide recognized by the antibody can be purified by immunoaffinity chromatography using the antibody of the present invention.

12. Production and Use of Polypeptide Array (1) Production of Polypeptide Array

A polypeptide array can be produced using the polypeptide of the present invention obtained in the above item 10 or the antibody of the present invention obtained in the above item 11.

The polypeptide array of the present invention includes protein chips, and comprises a solid support and the polypeptide or antibody of the present invention adhered to the surface of the solid support.

Examples of the solid support include plastic such as polycarbonate or the like; an acrylic resin, such as polyacrylamide or the like; complex carbohydrates, such as agarose, sepharose, or the like; silica; a silica-based material, carbon, a metal, inorganic glass, latex beads, and the like.

The polypeptides or antibodies according to the present invention can be adhered to the surface of the solid support according to the method described in *Biotechniques*, 27: 1258-61 (1999); *Molecular Medicine Today*, 5: 326-7 (1999); *Handbook of Experimental Immunology*, 4th edition, Blackwell Scientific Publications, Chapter 10 (1986); *Meth. Enzym.*, 34 (1974); *Advances in Experimental Medicine and Biology*, 42 (1974); U.S. Pat. No. 4,681,870; U.S. Pat. No. 4,282,287; U.S. Pat. No. 4,762,881, or the like.

The analysis described herein can be efficiently performed by adhering the polypeptide or antibody of the present invention to the solid support at a high density, though a high fixation density is not always necessary.

(2) Use of Polypeptide Array

A polypeptide or a compound capable of binding to and interacting with the polypeptides of the present invention adhered to the array can be identified using the polypeptide array to which the polypeptides of the present invention have been adhered thereto as described in the above (1).

Specifically, a polypeptide or a compound capable of binding to and interacting with the polypeptides of the present invention can be identified by subjecting the polypeptides of the present invention to the following steps (i) to (iv):

(i) preparing a polypeptide array having the polypeptide of the present invention adhered thereto by the method of the above (1);
(ii) incubating the polypeptide immobilized on the polypeptide array together with at least one of a second polypeptide or compound;
(iii) detecting any complex formed between the at least one of a second polypeptide or compound and the polypeptide immobilized on the array using, for example, a label bound to the at least one of a second polypeptide or compound, or a secondary label which specifically binds to the complex or to a component of the complex after unbound material has been removed; and
(iv) analyzing the detection data.

Specific examples of the polypeptide array to which the polypeptide of the present invention has been adhered include a polypeptide array containing a solid support to which at least one of a polypeptide containing an amino acid sequence selected from SEQ ID NOs:7552 to 15101, a polypeptide containing an amino acid sequence in which at least one amino acids is deleted, replaced, inserted or added in the amino acid sequence of the polypeptide and having substantially the same activity as that of the polypeptide, a polypeptide containing an amino acid sequence having a homology of 60% or more with the amino acid sequences of the polypeptide and having substantially the same activity as that of the polypeptides, a partial fragment polypeptide, and a peptide comprising an amino acid sequence of a part of a polypeptide.

The amount of production of a polypeptide derived from actinomycetes can be analyzed using a polypeptide array to which the antibody of the present invention has been adhered in the above (1).

Specifically, the expression amount of a gene derived from a mutant of actinomycetes can be analyzed by subjecting the gene to the following steps (i) to (iv);

(i) preparing a polypeptide array by the method of the above (1);
(ii) incubating the polypeptide array (the first antibody) together with a polypeptide derived from a mutant of actinomycetes;
(iii) detecting the polypeptide bound to the polypeptide immobilized on the array using a labeled second antibody of the present invention; and
(iv) analyzing the detection data.

Specific examples of the polypeptide array to which the antibody of the present invention is adhered include a polypeptide array comprising a solid support to which at least one of an antibody which recognizes a polypeptide comprising an amino acid sequence selected from SEQ ID NOs:7552 to 15101, a polypeptide comprising an amino acid sequence in which at least one amino acids is deleted, replaced, inserted or added in the amino acid sequence of the polypeptide and having substantially the same activity as that of the polypeptide, a polypeptide comprising an amino acid sequence having a homology of 60% or more with the amino acid sequences of the polypeptide and having substantially the same activity as that of the polypeptides, a partial fragment polypeptide, or a peptide comprising an amino acid sequence of a part of a polypeptide.

A fluctuation in an expression amount of a specific polypeptide can be monitored using a polypeptide obtained in the time course of culture as the polypeptide derived from actinomycetes. The culturing conditions can be optimized by analyzing the fluctuation.

When a polypeptide derived from a mutant of actinomycetes is used, a mutated polypeptide can be detected.

13. Identification of Useful Mutation in Mutant by Proteome Analysis

Usually, the proteome is used herein to refer to a method wherein a polypeptide is separated by two-dimensional electrophoresis and the separated polypeptide is digested with an enzyme, followed by identification of the polypeptide using a mass spectrometer (MS) and searching a database.

The two dimensional electrophoresis means an electrophoretic method which is performed by combining two electrophoretic procedures having different principles. For example, polypeptides are separated depending on molecular weight in the primary electrophoresis. Next, the gel is rotated by 900 or 1800 and the secondary electrophoresis is carried out depending on isoelectric point. Thus, various separation patterns can be achieved (JIS K 3600 2474).

In searching the database, the amino acid sequence information of the polypeptides of the present invention and the recording medium of the present invention provide for in the above items 2 and 8 can be used.

The proteome analysis of an actinomycetes and its mutant makes it possible to identify a polypeptide showing a fluctuation therebetween.

The proteome analysis of a wild type strain of actinomycetes and a production strain showing an improved productivity of a target product makes it possible to efficiently identify a mutation protein which is useful in breeding for improving the productivity of a target product or a protein of which expression amount is fluctuated.

Specifically, a wild type strain of actinomycetes and a avermectin-producing strain thereof are each subjected to the proteome analysis. Then, a spot increased in the avermectin-producing strain, compared with the wild type strain, is found and a database is searched so that a polypeptide showing an increase in yield in accordance with an increase in the lysine productivity can be identified.

As a result that a protein having a high expression level is identified by proteome analysis using the nucleotide sequence information and the amino acid sequence information, of the genome of the actinomycetes of the present invention, and a recording medium storing the sequences, the nucleotide sequence of the gene encoding this protein and the nucleotide sequence in the upstream thereof can be searched at the same time, and thus, a nucleotide sequence having a high expression promoter can be efficiently selected.

In the proteome analysis, a spot on the two-dimensional electrophoresis gel showing a fluctuation is sometimes derived from a modified protein. However, the modified protein can be efficiently identified using the recording medium storing the nucleotide sequence information, the amino acid sequence information, of the genome of actinomycetes, and the recording medium storing the sequences, according to the present invention.

Moreover, a useful mutation point in a useful mutant can be easily specified by searching a nucleotide sequence (nucleotide sequence of promoters, ORF, or the like) relating to the thus identified protein using a recording medium storing the nucleotide sequence information and the amino acid sequence information, of the genome of actinomycetes of the present invention, and a recording medium storing the sequences and using a primer designed on the basis of the detected nucleotide sequence. As a result that the useful mutation point is specified, an industrially useful mutant having the useful mutation or other useful mutation derived therefrom can be easily bred.

The present invention will be explained in detail below based on Examples. However, the present invention is not limited thereto.

EXAMPLE 1

Determination of Full Nucleotide Sequence of the Genome of *Streptomyces avermitilis*:

The full nucleotide sequence of the genome of *Streptomyces avermitilis* was determined based on the whole genome shotgun method (*Science*, 269: 496-512 (1995)). In this method, a genomic library was prepared, the terminal sequences were determined at random, and the sequences were ligated on a computer to cover the full genome. Specifically, Specifically, the following procedure was carried out.

(1) Preparation of Genome DNA of Determination of *Streptomyces avermitilis* ATCC 31267

*Streptomyces avermitilis* ATCC 31267 was cultured at 30° C. overnight in 5 ml of a TSB medium (17 g/l peptone, 3 g/l soybean peptone, 5 g/l sodium chloride, 2.5 g/l glucose, 2.5 g/l potassium secondary phosphate, pH 7.3), and the cells were recovered by centrifugation. The cells were washed with STE buffer (10.3% sucrose, 25 mmol/l Tris-HCl, 25 mmol/l EDTA, pH 8.0), mixed with 2.5 ml of a low melting point agarose for 1.5% pulse field electrophoresis sample preparation use (InCert agarose, manufactured by Takara Shuzo), poured into a Petri dish of 80 mm in diameter and then allowed to stand at room temperature for 30 minutes or more for solidification.

To the Petri dish, 20 ml of the STE buffer containing 1 to 5 mg/ml lysozyme was added, and incubated at 30° C. for 6 to 20 hours to digest the cell walls. The STE buffer was discarded, and the dish was washed with TE buffer (10 mmol/l Tris-HCl, 1 mmol/l EDTA, pH 8.0), supplemented with 10 ml of a lysis buffer (0.5 mol/l EDTA, pH 9.5, 1% sarcosyl) containing 1 mg/ml proteinase K, followed gently shaking at 50° C. for 24 hours. After the shaking, the buffer was removed and the dish was washed several times with 20 ml of a 50 mmol/l EDTA solution of pH 8.0. The remaining proteinase K was inactivated by further adding a 50 mmol/l EDTA solution of pH 8.0 containing 1 mM PMSF.

Thus treated genome DNA-containing agarose gel was cut out as a block of 5×5 mm, and put into a sample ditch of 1% agarose gel (45 mmol/l Tris-borate, 1 mmol/l EDTA, 0.1 mmol/l thiourea, pH 8.3), and the gel was filled with an electrophoresis buffer to carry out electrophoresis under pulse conditions of 3 seconds for a forward direction and 1 second for a backward direction at 120 volts overnight.

After the electrophoresis, an agarose block was cut out and washed with a 50 mmol/l EDTA solution of pH 8.0. The washed agarose block was dissolved by incubation at 65° C., Tris neutral phenol (5 to 10 ml) was added thereto, followed by gently shaking at room temperature for 5 minutes, and then 5 to 10 ml of chloroform is further added thereto, followed by gently shaking for 5 minutes.

After the shaking, centrifugation (10,000×g, 10 minutes, 20° C.) was carried out, and the aqueous phase was collected. The aqueous phase was subjected to extraction with 10 to 20 ml of phenol/chloroform twice, and then ¹⁄₁₀ volume of a 3 mol/l sodium acetate solution and 0.56 volume of isopropanol were added to the aqueous phase, followed by gently mixing to thereby precipitate genome DNA. The resulting genome DNA precipitate is washed with 70% ethanol, followed by air drying, and then dissolved in TE buffer to obtain a genome DNA solution.

The thus formed genome DNA precipitate was washed with 70% ethanol, air-dried and then dissolved in TE buffer to obtain a genome DNA solution.

(2) Construction of Shotgun Library

A buffer such as TE buffer was added to 0.1 mg of the actinomycetes genome DNA prepared in the above to give a total volume of 0.4 ml. Then, the genome DNA was cut by shearing force into fragments of 1 to 2 kb with HydroShare (manufactured by Gene Machines) at an output of 6 twenty times.

The resulting genome DNA fragments were passed through Size Sep 400 Span Column (Sepharose CL4B, manufactured by Amersham) to thereby eliminate fragments of 500 bp or less.

The DNA fragments from which the fragments of 500 bp or less had been eliminated were blunt-ended using DNA blunting kit (manufactured by Takara Shuzo).

The blunt-ended DNA fragments were recovered by subjecting to phenol/chloroform treatment and then to ethanol precipitation and used as a genome library insert.

The insert was ligated by allowing it to stand at 10 to 20° C. for 24 hours in pUC118 HincII/BAP (manufactured by Takara Shuzo) using T4 DNA ligase (manufactured by Takara Shuzo).

The thus obtained ligation reaction product was precipitated with ethanol and dissolved in 5 to 20 μl of TE buffer.

*Escherichia coli* Electro-Cells DH5α (manufactured by Takara Shuzo) was transformed by electroporation using 0.5 μl of the ligation solution.

The transformed *Escherichia coli* was cultured by spreading it on LB plate agar medium (LB medium (10 g/l Bactotripton, 5 g/l yeast extract, 10 g/l sodium chloride, pH 7.0) containing 1.5% of agar) containing 100 mg/l ampicillin and 0.4 mg/l X-gal (5-bromo-4-chloro-3-indoyl-β-D-galactopyranoside). Also, a transformant comprising a recombinant DNA containing the genome DNA was selected as a white colony.

The white colony transformant was statically cultured at 37° C. overnight in a 96 well titer plate to which LB medium containing 0.1 mg/ml ampicillin had been added at 0.05 ml/well. After the culturing, 50% glycerol was added at 0.05 ml/well to the culture medium, mixed and stored at −80° C.

(3) Construction of Cosmid Library

About 0.1 mg of the genome DNA of *Streptomyces avermitilis* ATCC 31267 was partially digested with a restriction enzyme MboI and subjected to field-inversion electrophoresis (0.3 second in forward direction, 0.1 second in backward direction) using low melting point agarose gel.

After the electrophoresis, agarose gel fractions mainly comprising DNA fragments of about 40 kb were collected, and the agarose gel was dissolved at 65° C. The dissolved solution was subjected to phenol treatment and chloroform treatment in this order, and then the aqueous phase was separated and the DNA was precipitated with ethanol.

The thus obtained DNA fragments were mixed with BamHI-digested pKU402 (*Actonomycetol.*, 8: 21-25 (1994)), adjusted to a concentration of 0.3 mg/ml and then ligated using T4 DNA ligase (manufactured by Takara Shuzo).

The thus obtained ligation product was subjected to packaging using a commercially available packaging extract, Ready-To-Go Lambda Packaging Kit (manufactured by Amersham), in accordance with the manufacture's instructions and then introduced into *Escherichia coli* XL-1-BlueMR (manufactured by Stratagene).

The transformed *Escherichia coli* was spread on an LB plate medium containing ampicillin, followed by culturing at 30° C. overnight.

The transformant was statically cultured in a 96-well titer plate supplemented with 0.05 ml/well of LB medium containing 0.1 mg/ml ampicillin, and then 50% glycerol was added to the culture medium at 0.05 ml, mixed and stored at −80° C.

(4) Determination of Nucleotide Sequence (4-1) Preparation of Template

The full nucleotide sequence of *Streptomyces avermitilis* ATCC 31267 genome was determined based on the whole genome shotgun method. The template used in this method was prepared using PCR method from the library prepared in the above item (2).

Specifically, the clones derived from the whole genome shotgun library were inoculated using a replicator (manufactured by GENETIX) into a 96 well titer plate in which LB medium containing 0.1 mg/ml ampicillin had been dispensed at 0.08 ml/well, followed by static culture at 30° C. overnight.

The culture medium was diluted 40 times with sterile water, a 5 μl portion thereof was mixed with 5 μl of a solution containing 100 μg/ml M13 forward (5'-GTGCTGCAAGGC-GATTAAGTTGG-3'; SEQ ID NO:15104) and reverse (5'-TCCGGCTCGTATGTTGTGTGGA-3'; SEQ ID NO:15105) primers, Ex Taq buffer (manufactured by Takara Shuzo), 5 nmol/l DATP, dGTP, dCTP and dTTP, and 0.25 U of TakaRa Ex Taq (manufactured by Takara Shuzo), and amplification of inserted fragments was carried out using Biometra (manufactured by Biotron) at 96° C. for 5 minutes and a succeeding cycle of 96° C. for 15 seconds and 70° C. for 60 seconds 20 to 40 times.

The excessive primers and nucleotides were eliminated using a kit for purifying a PCR product (manufactured by Amersham Pharmacia Biotech), and the product was used as the sequencing reaction template.

Also, the nucleotide sequence was determined using a double-stranded DNA plasmid as the template. The double-stranded DNA plasmid as the template was obtained by the following method. The clones derived from the whole genome shotgun library were inoculated into respective wells of a 96 well titer plate in which TSB medium (17 g/l peptone, 3 g/l soybean peptone, 5 g/l sodium chloride, 2.5 g/l glucose, 2.5 g/l potassium secondary phosphate, pH 7.3) containing 0.05 mg/ml ampicillin had been dispensed at 1 ml/well, followed by static culture at 30° C. overnight.

The double-stranded DNA plasmid was prepared from the thus obtained culture medium using a plasmid automatic preparation machine HURABO PI-50 (manufactured by KURABO) or MultiScreen (manufactured by Millipore), in accordance with the manufacture's instructions of KURABO or Millipore. The thus obtained purified double-stranded DNA plasmid was dissolved in water to give a concentration of about 0.1 mg/ml and used as the sequencing template.

(4-2) Sequencing Reaction

With 6 μl of ABI PRISM BigDye Terminator Cycle Sequencing Ready Reaction Kit (manufactured by PE Biosystems) solution, M13 forward (M13-21) primer or M13 reverse (M13 REV) primer (*DNA Research*, 5: 1-9 (1998)) and the primer (PCR product or plasmid) obtained in the item (4-1) were mixed to thereby obtain 10 μl of a sequence reaction solution. Amounts of the primer and template were 1.6 pmole and 50 to 200 ng, respectively.

Using the reaction solution, 45 cycles of dye terminator sequence reaction was carried out by GeneAmp PCR System 9700 (manufactured by PE Biosystems). The cycle parameters were used in accordance with the manufacture's instructions of ABI PRISM BigDye Terminator Cycle Sequencing Ready Reaction Kit. The sample was purified using Multi-Screen HV plate (manufactured by Millipore) in accordance with the manufacture's instruction of Millipore. The thus purified reaction product was stored at −30° C. in the dark.

The dried reaction product was analyzed using ABI PRISM 3700 DNA Analyser (manufactured by PE Biosystems) in accordance with the manufacture's instruction.

The data of about 200,000 reactions obtained by the 3700 DNA Analyser were preserved by transferring into a server (Alpha Server ES40; manufactured by Compaq). The data of about 200,000 reactions corresponded to about 10 times of the genome size.

(5) Assembly

All procedures were carried out based on the UNIX platform. The base call was carried out by phred (The University of Washington), and the vector sequence removal by Cross Match (The University of Washington) and the assembly by phrap (The University of Washington). The contig obtained as the result of assembly was analyzed using a graphical editor consed (The University of Washington). A series of procedures from the base call to assembly were carried out in one lot using a script phredPhrap attached to consed.

(6) Nucleotide Sequence Determination of Gap Region

Each cosmid in the cosmid library constructed in the item (3) was prepared by a method similar to the production method of the double-stranded DNA plasmid described in the item (4-1). The nucleotide sequences of the insertion fragment termini of the cosmid were determined using ABI PRISM BigDye Terminator Cycle Sequencing Ready Reaction Kit (manufactured by PE Biosystems) in accordance with the manufacture's instructions.

Sequencing of both termini of insertion fragments of about 4,000 cosmid clones was carried out, and nucleotide sequences in the shotgun sequencing derived contigs obtained in the item (5) identical to these sequences were screened. By this operation, linkage relationship between each cosmid clone and each contig was revealed and mutual alignment was carried out.

Also, the sequence of a region uncovered by the contig (gap region) was determined by the following method.

Clones containing sequences positioned at contig termini were selected. About 4,000 clones in which only the sequences of one side terminus of insertion fragments were determined were selected from these clones. Subsequently, by identifying whole genome-derived shotgun library clones or cosmid clones in which sequences of respective termini of insertion fragments were contained in two contigs, and by determining full nucleotide sequences of insertion fragments of the clones, the nucleotide sequence of this gap region was determined. In the case of the absence of a shotgun library clone or cosmid clone covering the gap region, the nucleotide sequence of the region was determined by amplifying a DNA fragment of the gap region which was prepared by PCR using primers complementary to the contig termini sequences, and then carrying out the sequencing by a primer walking method using the amplified product as the template or by a shotgun method in which sequence of a shotgun clone prepared from the amplified PCR fragment is determined.

Regarding a region having low sequence accuracy, the sequence accuracy was improved by synthesizing primers making use of the AUTOFINISH function and NAVIGATING function of the consed (The University of Washington), and carrying out the sequence determination by the primer walking method. The nucleotide sequences of the *Streptomyces avermitilis* ATCC 31267 genome determined in this manner are shown in SEQ ID NO:1.

(7) Identification and Function Estimation of ORF

ORFs in the nucleotide sequences shown in SEQ ID NO:1 were identified in the following manner. First, the ORF regions was estimated on the UNIX platform using ORF identification software Glimmer, GeneMark and GeneMark.hmm in accordance with the manual attached to the software. Also, published data on 1,000 ORFs of *Streptomyces coelicolor* A3(2) were used as corresponding learning materials. Based on these results, ORFs in the nucleotide sequences shown in SEQ ID NO:1 were identified.

The function of ORFs was estimated by retrieving homology of the identified ORF nucleotide sequences from amino acid databases such as Swiss-Prot, PIR, GenPept, and the like which are databases of protein coding regions derived from the GenBank database, or by retrieving homology of the identified ORF amino acid sequences from amino acid databases such as Swiss-Prot, PIR, GenPept, and the like which are databases of protein coding regions derived from the GenBank database, using a homology retrieving software BLAST. The ORF nucleotide sequences determined in this manner are shown in SEQ ID NOs:2 to 7552, and the amino acid sequences encoded by the ORFs in SEQ ID NOs:7552 to 15101.

EXAMPLE 2

Screening and Identification of Biosynthetic Gene Cluster of New Polyketide Compound Oligomycin:

(1) Screening of Oligomycin Biosynthetic Gene Cluster

*Streptomyces avermitilis* produces a polyketide compound avermectin having parasiticidal activity and insecticidal activity and also produces other several polyketide compounds. However, there is no information on the presence of the biosynthetic genes, and their distinctive identification has not been accomplished even by carrying out Southern hybridization using a part of the avermectin biosynthetic gene as the probe. By the way, it is known by the analysis of polyketide synthase genes that, among their functional domains, the domains related to β-ketoacyl-ACP synthesis and acyl transfer have high amino acid sequence homology in comparison with other domains (*Science*, 252: 675 (1991), *Proc. Natl. Acad. Sci. USA*, 96: 9509 (1999)).

When BLAST retrieval was carried out on the amino acid sequences of the domains related to β-ketoacyl-ACP synthesis and acyl transfer of the nucleotide sequences of the biosynthetic gene cluster of avermectin produced by *Streptomyces avermitilis* and the nucleotide sequences shown in SEQ ID NO:1, regions considered to be several polyketide synthase genes were found. Among these, two genes having a total length of 60 kb or more were analyzed. When ORF retrieval of the nucleotide sequence shown in SEQ ID NO:15102 was carried out, it was confirmed that seven polyketide synthase genes are encoded in this region. The constitution of domains was also revealed by retrieving homology of deduced amino acid sequences with each domain of the polyketide synthase (FIG. 1). As a result of the domain constitution analysis, it was estimated that 17 modules (domains concerned in the acyl side chain elongation) are present in the deduced seven polyketide synthases and condensation is carried out 16 times. The result coincided with the polyketide skeleton of oligomycin.

(2) Identification of Oligomycin Biosynthetic Gene Cluster

It was considered that the nucleotide sequence shown in SEQ ID NO:15102 contains an oligomycin biosynthetic gene cluster. In order to confirm this, insertion mutation was applied to a region coding for the polyketide synthase by homologous recombination and its influence on the oligomycin production was examined. Among the nucleotide sequence shown in SEQ ID NO:15102, a 3.53 kb BamHI fragment of from the 100,926th base to the 104,455th base of the region considered to encode the polyketide synthase was cut out from a cosmid clone containing a region encoding the polyketide synthase and subcloned into the BamHI site of pUC19. Since the 3,530 bp BamHI fragment contains one BglII site, a 1.95 kb BamHI fragment containing a streptomycin-spectinomycin resistance gene (aad3") was ligated to this site.

The thus ligated product was introduced into *Escherichia coli* DH10B, and the transformant of interest was selected using LA medium containing 0.1 mg/ml ampicillin and 0.1 mg/ml spectinomycin. After extraction of plasmid DNA from the transformant, a 5.48 kb BamHI fragment cloned by digesting with BamHI was cut out and ligated to the BamHI site of pKC7. The ligated product was introduced into *Escherichia coli* DH10B, and the transformant of interest was selected using LA medium containing 0.05 mg/ml kanamycin, 0.1 mg/ml ampicillin and 0.1 mg/ml spectinomycin. Since *Streptomyces avermitilis* restricts DNA methylated with Dam and Dcm, it is necessary to transform *Streptomyces avermitilis* using DNA prepared from *Escherichia coli* from which such methylation had been deleted. Accordingly, plasmid DNA was extracted from the transformant obtained in the above to transform a dam and dcm defective *Escherichia coli* strain GM2929. *Streptomyces avermitilis* was made into protoplasts in the usual way, transformed with the plasmid DNA obtained from the transformant using polyethylene glycol, spread on a regeneration medium and then cultured at 30° C.

Twenty hours after the culturing, soft agar containing 0.1 mg/ml neomycin was layered over the medium in an amount of 2.5 ml per one plate, and transformant were selected by continuing the culturing for 7 days.

Transformants grown on the selection medium were collected, spread on YMS agar medium (4 g/l yeast extract, 10 g/l malt extract, 4 g/l soluble starch, 20 g/l agar, pH 7.5) and cultured at 30° C. for 7 days. Spores formed on the surface were scraped, spread on the YMS agar medium to give a density of 200 colonies per plate and cultured at 30° C. for 5 days.

After confirming formation of spores, colonies were replicated on two media, namely YMS agar plate medium containing 0.1 mg/ml spectinomycin and YMS agar plate medium containing 0.002 mg/ml neomycin and 0.1 mg/ml spectinomycin, and cultured at 30° C. for 5 days.

Among colonies grown on respective plates, homologous recombinants which formed double crossover recombination event showing neomycin sensitivity and spectinomycin resistance were selected.

Recombinants having insertion mutation in the polyketide synthase region, caused by the homologous recombination, were transferred on a production medium (46 g/l glucose, 24 g/l peptonized milk, 2.5 g/l yeast extract, 20 g/l agar, pH 7.5) in a patch shape of 1 square centimeter and cultured at 28° C. for 7 days.

After completion of the culturing, each of the recombinants grown in a patch-shape was hollowed out, and the culture product accumulated in the cells was extracted with 0.5 ml of methanol.

Accumulation of avermectin was observed in the culture product of all recombinants, but oligomycin was not accumulated. Based on the results, it was revealed that the 7 kinds of ORF contained in SEQ ID NO:15102 encode oligomycin biosynthesis enzymes.

EXAMPLE 3

Screening and Identification of Biosynthetic Gene Cluster of New Polyketide Compound Pentaene (1) Screening of Pentaene Biosynthetic Gene Cluster When BLAST retrieval was carried out on the amino acid sequences of the domains related to β-ketoacyl-ACP synthesis and acyl transfer of the nucleotide sequences of the biosynthetic gene cluster of avermectin produced by *Streptomyces avermitilis* and the nucleotide sequences shown in SEQ ID NO:1, regions considered to be several polyketide synthase genes were found.

Among these, one of two gene clusters having a total length of 60 kb or more was found to be an oligomycin biosynthetic gene cluster.

Retrieval of ORF was carried out on the other gene cluster in the same manner as the analysis of oligomycin biosynthetic gene.

Figure 2:
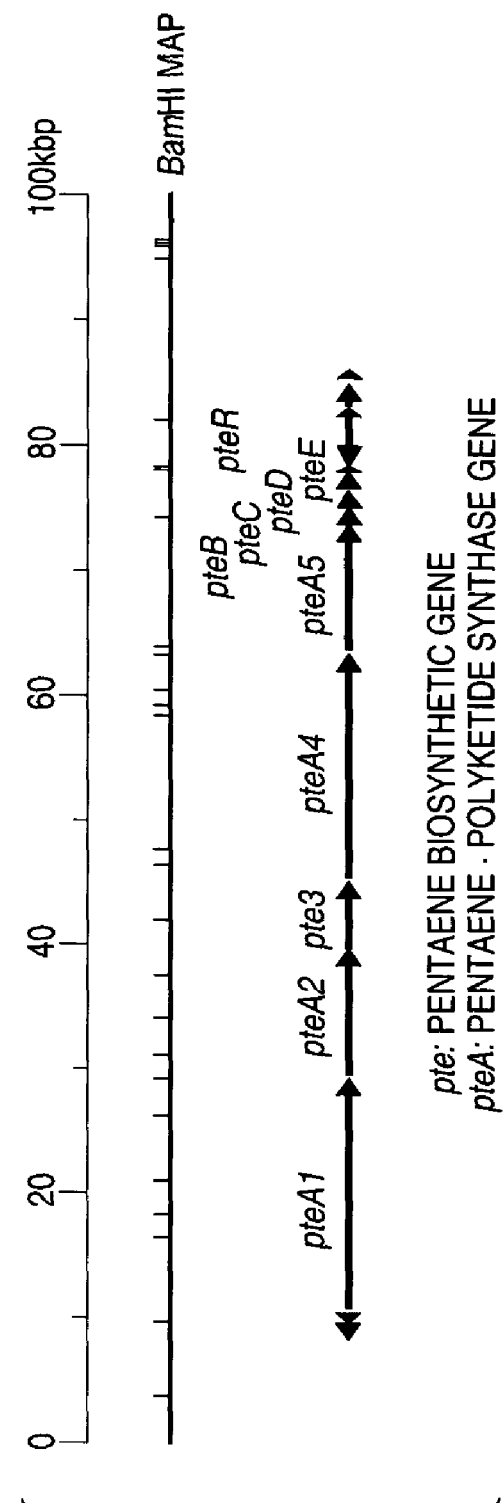
FIG. 2 is a drawing showing the construction of the gene in the region relating to the biosynthesis of pentaene on the genome of *Streptomyces avermitilis* ATCC 31267.
Figure 3:
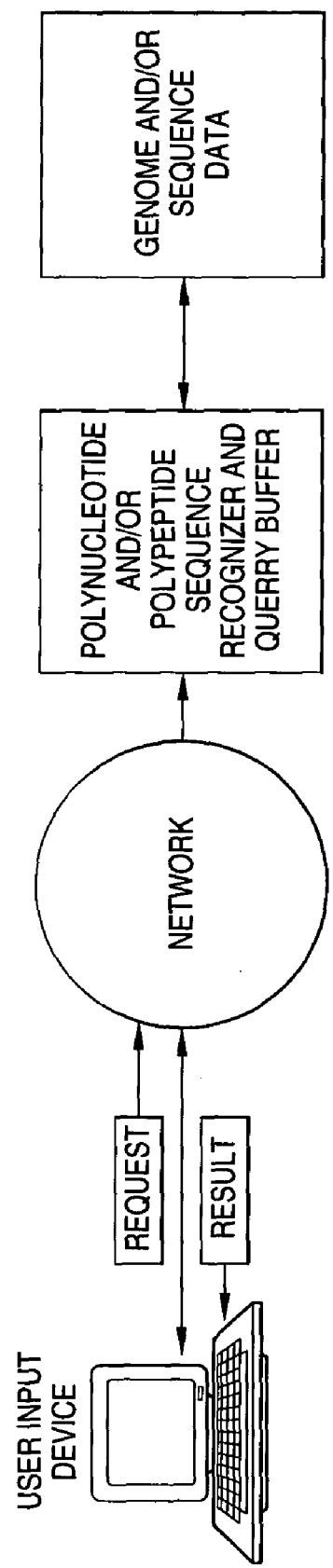
FIG. 3 is a flow chart of an example of a system using the computer readable media according to the present invention.
Figure 4:
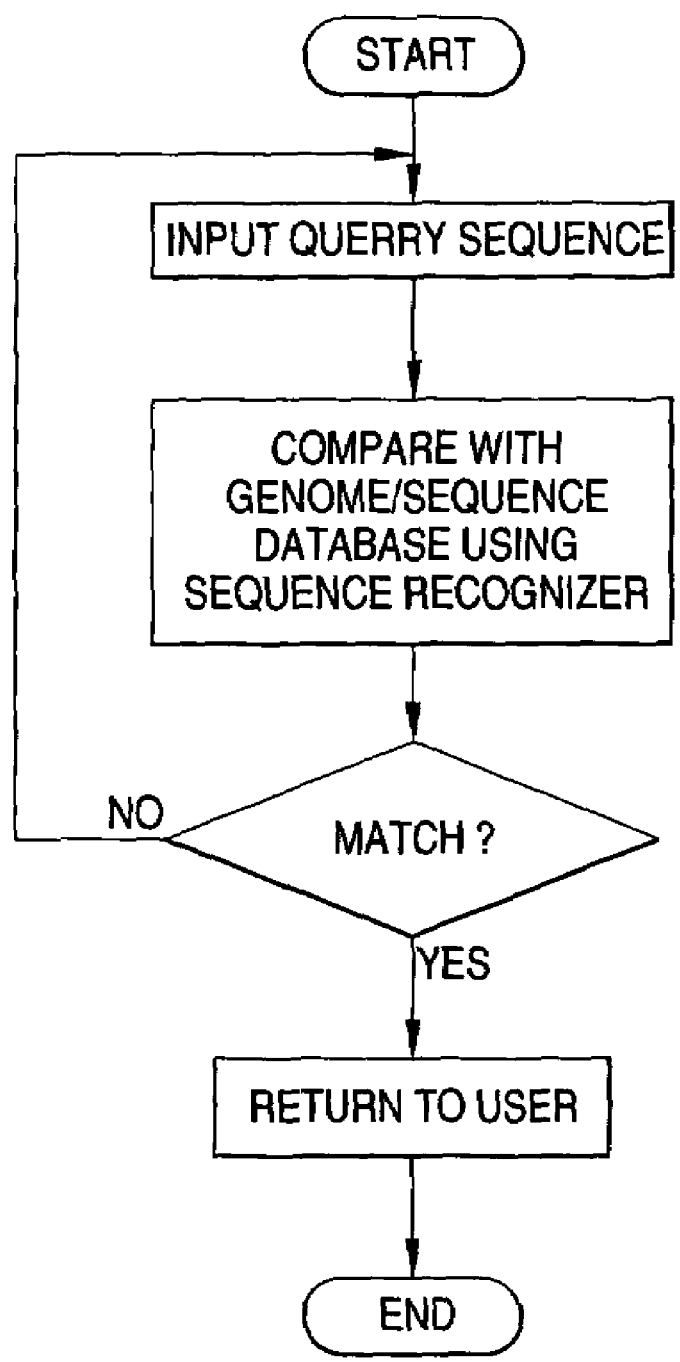
FIG. 4 is a flow chart of an example of a system using the computer readable media according to the present invention.

When ORF retrieval of the nucleotide sequence shown in SEQ ID NO:15103 was carried out, it was confirmed that five polyketide synthase genes are encoded in this region. The constitution of domains was also revealed by retrieving homology of deduced amino acid sequences with each domain of the polyketide synthase (FIG. 2). As a result of the domain constitution analysis, it was estimated that 14 modules are present in the deduced five polyketide synthases and condensation is carried out 13 times. The result coincided with the polyketide skeleton of a pentaene compound, filipin.

(2) Identification of Pentaene Biosynthetic Genes

It was considered that the nucleotide sequence shown in SEQ ID NO:15103 contains a pentaene biosynthetic gene cluster.

In order to confirm this, insertion mutation was applied to a region coding for the polyketide synthase by homologous recombination and its influence on the pentaene production was examined.

Among the nucleotide sequence shown in SEQ ID NO:15103, a 5.56 kb SacI fragment of from the 43,293rd base to the 48,851st base of the region considered to encode the polyketide synthase was cut out from a cosmid clone containing a region encoding the polyketide synthase and subcloned into the SacI site of pUC19. Since the 5.56 kb SacI fragment contains one EcoRV site, a 1.95 kb DraI fragment containing a streptomycin-spectinomycin resistance gene (aad3") was ligated to this site.

The ligated product was introduced into *Escherichia coli* DH10B, and the transformant of interest was selected using LA medium containing 0.1 mg/ml ampicillin and 0.1 mg/ml spectinomycin. After extraction of plasmid DNA from the transformant, a 7.51 kb EcoRI-HindIII fragment cloned by digesting with EcoRI and HindIII was cut out and ligated to the EcoRI/HindIII site of pKC7.

The thus ligated product was introduced into *Escherichia coli* DH10B, and the transformant of interest was selected using LA medium containing 0.05 mg/ml kanamycin, 0.1 mg/ml ampicillin and 0.1 mg/ml spectinomycin.

Since *Streptomyces avermitilis* restricts methylated DNA as described above, plasmid DNA was extracted from the transformant obtained above to transform a dam and dcm defective *Escherichia coli* strain GM2929.

Using methylation-free plasmid DNA obtained from the transformant, *Streptomyces avermitilis* protoplasts were transformed by a polyethylene glycol method, spread on a regeneration medium and then cultured at 30° C.

Twenty hours after the culturing, soft agar containing 0.1 mg/ml neomycin was overcoated on the medium in an amount of 2.5 ml per one plate, and a transformant was selected by continuing the culturing for 7 days.

Transformants grown on the selection medium were collected, spread on YMS agar medium (4 g/l yeast extract, 10 g/l malt extract, 4 g/l soluble starch, 20 g/l agar, pH 7.5) and cultured at 30° C. for 7 days. Spores formed on the surface were scraped, spread on the YMS agar medium to give a density of 200 colonies per plate and cultured at 30° C. for 5 days.

After confirming formation of spores, colonies were replicated on two media, namely YMS agar plate medium containing 0.1 mg/ml spectinomycin and YMS agar plate medium containing 0.002 mg/ml neomycin and 0.1 mg/ml spectinomycin, and cultured at 30° C. for 5 days.

Among colonies grown on respective plates, homologous recombinants which formed double crossover recombination event showing neomycin sensitivity and spectinomycin resistance were selected.

Recombinants having insertion mutation in the polyketide synthase region, caused by the homologous recombination, were transferred on a production medium (40 g/l soluble starch, 20 g/l soybean meal, 0.5 g/l ferrous sulfate heptahydrate, 1 g/l potassium secondary phosphate, 0.3 g/l potassium chloride, 20 g/l agar, pH 6.5) in a patch shape of 1 square centimeter and cultured at 28° C. for 7 days.

After completion of the culturing, each of the recombinants grown in a patch-shape was hollowed out, and the culture product accumulated in the cells was extracted with 0.5 ml of methanol. Accumulation of avermectin was observed in the culture product of all recombinants, but pentaene was not accumulated. Based on the results, it was revealed that the 5 kinds of ORF contained in SEQ ID NO:15103 encode pentaene biosynthesis enzymes.

As is demonstrated by the discovery of biosynthetic genes of new polyketide compounds described above, the present invention provides an effective and quick screening method for discovering a biosynthetic gene cluster of polyketide compounds without using conventional cloning techniques of molecular genetics. In addition, the discovered domain constitution of polyketide synthase also provides useful information for the creation of novel polyketide compounds. This methodology for quick screening of polyketide compounds is an approach which can be carried out efficiently by making use of the genomic nucleotide sequence information disclosed by the present invention, and its effectiveness was found for the first time by the present invention.

EXAMPLE 4

Homologue Retrieval Using *Streptomyces avermitilis* Genome Sequence:

(1) Retrieval of Transketolase

An *Escherichia coli* transketolase sequence (ECTKT) was obtained from Swiss-prot database as the amino acid sequence of a protein whose function as transketolase (EC 2.2.1.1) had been confirmed. Using the full length of the amino acid sequence as the query, homology retrieval was carried out using FASTA program on a nucleotide sequence database of the genome sequences of *Streptomyces avermitilis* or on a database of the amino acid sequences of ORF region deduced from the genome sequences. The presence of significant homology was judged by the E-value of $10^{-10}$ or less.

As a result, significant homology of *Escherichia coli* transketolase ORF was found with the ORF having the nucleotide sequence represented by SEQ ID NO:1755 and the amino acid sequence encoded by the ORF having the nucleotide sequence represented by SEQ ID NO:6292, from the nucleotide sequence database of the genome sequences of *Streptomyces avermitilis* or the database of the amino acid sequences of ORF region deduced from the genome sequences.

In order to examine similarity between the ORF-encoded amino acid sequences and transketolase of other organism species in detail, retrieval was carried out using the amino acid sequences as the query and using BLAST program, on an amino acid sequence database prepared from those which are registered in GenBank (http://www.ncbi.nlm.nih.gov/)nr-aa database, PDB database, Swiss-Prot database, PIR database and PRF database by excluding overlapped parts.

As a result, each of the two amino acid sequences showed significant homology with transketolase of other organism species, and the homology with transketolase was clearly higher than the homology with amino acid sequences of other proteins, so that it was considered that two ORFs encoding a protein having transketolase activity are present in *Streptomyces avermitilis*.

(2) Retrieval of Transaldolase

*Escherichia coli* transketolase sequences TalA (D13159) and TalB (S80045) were obtained from Swiss-prot database as the amino acid sequences of proteins whose function as transaldolase (EC 2.2.1.2) had been confirmed. Using the full length of the amino acid sequences as the query, homology retrieval was carried out using FASTA program on a nucleotide sequence database of the genome sequences of *Streptomyces avermitilis* or on a database of the amino acid sequences of ORF region deduced from the genome sequences. The presence of significant homology was judged by the E-value of $10^{-10}$ or less.

As a result, significant homology of *Escherichia coli* transketolase TalA and TalB ORFs was found with the ORF having the nucleotide sequence represented by SEQ ID NO:1756 and the amino acid sequence encoded by the ORF having the nucleotide sequence represented by SEQ ID NO:6291, from the nucleotide sequence database of the genome sequences of *Streptomyces avermitilis* or the database of the amino acid sequences of ORF region deduced from the genome sequences.

In order to examine similarity between the ORF-encoded amino acid sequences and transketolase of other organism species in detail, retrieval was carried out using the amino acid sequences as the query and using BLAST program, on an amino acid sequence database prepared from those which are registered in GenBank (http://www.ncbi.nlm.nih.gov/)nr-aa database, PDB database, Swiss-Prot database, PIR database and PRF database by excluding overlapped parts.

As a result, both of the two amino acid sequences showed significant homology with transaldolase of other organism species, and the homology with transaldolase was clearly higher than the homology with amino acid sequences of other proteins, so that it was considered that two ORFs encoding a protein having transketolase activity are present in *Streptomyces avermitilis*. Also, the ORF shown by SEQ ID NO:1756 was adjacent to the downstream of ORF shown by SEQ ID NO:1755. On the other hand, the ORF shown by SEQ ID NO:6291 was also adjacent to the downstream of ORF shown by SEQ ID NO:6292.

(3) Retrieval of Glucose-6-Phosphate Dehydrogenase

An *Escherichia coli* glucose-6-phosphate dehydrogenase sequence (accession No. M55005) was obtained from Swiss-prot database as the amino acid sequence of a protein whose function as glucose-6-phosphate dehydrogenase (EC 1.1.1.49) had been confirmed. Using the full length of the amino acid sequence as the query, homology retrieval was carried out using FASTA program on a nucleotide sequence database of the genome sequences of *Streptomyces avermitilis* or on a database of the amino acid sequences of ORF region deduced from the genome sequences. The presence of significant homology was judged by the E-value of $10^{-10}$ or less.

As a result, significant homology of *Escherichia coli* glucose-6-phosphate dehydrogenase ORF was found with the ORF having the nucleotide sequence represented by SEQ ID NO:1757 and the amino acid sequence encoded by the ORF having the nucleotide sequence represented by SEQ ID NO:6290, from the nucleotide sequence database of the genome sequences of *Streptomyces avermitilis* or the database of the amino acid sequences of ORF region deduced from the genome sequences.

In order to examine similarity between the ORF-encoded amino acid sequences and transketolase of other organism species in detail, retrieval was carried out using the amino acid sequences as the query and using BLAST program, on an amino acid sequence database prepared from those which are registered in GenBank (http://www.ncbi.nlm.nih.gov/)nr-aa database, PDB database, Swiss-Prot database, PIR database and PRF database by excluding overlapped parts.

As a result, each of the two amino acid sequences showed significant homology with glucose-6-phosphate dehydrogenase of other organism species, and the homology with glucose-6-phosphate dehydrogenase was clearly higher than the homology with amino acid sequences of other proteins, so that it was considered that proteins having amino acid sequences encoded by the two ORFs function as glucose-6-phosphate dehydrogenase. Based on the results, it was considered that two ORFs encoding a protein having glucose-6-phosphate dehydrogenase activity are present in *Streptomyces avermitilis*. Also, the ORF shown by SEQ ID NO:1756 was adjacent to the downstream of ORF shown by SEQ ID NO:1755. On the other hand, the ORF shown by SEQ ID NO:6290 was also adjacent to the downstream of ORF shown by SEQ ID NO:6291.

Based on these results, it was revealed that the ORF shown by SEQ ID NO:1755, the ORF shown by SEQ ID NO:1756 and the ORF shown by SEQ ID NO:1757 form an operon, and the ORF shown by SEQ ID NO:6292, the ORF shown by SEQ ID NO:6291 and the ORF shown by SEQ ID NO:6290 also form an operon.

EXAMPLE 5

Screening of New Secondary Metabolite Biosynthetic Gene Clusters:

It is known that the genus *Streptomyces* produces a great variety of secondary metabolites. Based on their biosynthetic pathway, the secondary metabolites can be classified into melanin, β-lactam, peptide, aminoglycoside, aromatic polyketide (containing an aromatic ring such as tetracycline, quinone and anthracycline), macrolide (including large ring lactone and lactam), shikimic acid, terpene, siderophore compounds and the like. Melanin compounds are formed by condensation of aromatic amino acid metabolites. β-Lactam and peptide compounds are formed by condensation of amino acids by a nonribosomal peptide synthetase without peptide elongation by a ribosome. Aminoglycoside antibiotics are formed by glycosidation of saccharide and aminocyclitol. Aromatic polyketide compounds are formed from acetic acid or malonic acid via condensation, dehydration and cyclization with type II polyketide synthase. Large ring lactones (including lactam) such as macrolide and the like are formed from a lower fatty acid such as acetic acid or propionic acid or a dicarboxylic acid thereof via a reaction such as condensation or the like with type I polyketide synthase, followed by cyclization to form lactone or lactam. Shikimic acid compounds are formed by metabolism of an aromatic amino acid. Terpene compounds are formed by condensation of isoprenoid-2-phosphate. Also, siderophore compounds are formed by binding of succinic acid and diaminocarboxylic acid.

When BLAST retrieval of amino acid sequences of the already reported secondary metabolite biosynthetic enzymes and the nucleotide sequences shown in SEQ ID NO:1 was carried out, 27 regions considered to be secondary metabolite biosynthetic gene clusters were found in addition to those of avermectin, oligomycin and polyene compounds. Details of the 27 gene groups were 4 gene clusters relating to the formation of melanins (including aromatic melanin), 5 gene cluster relating to the formation of terpene compounds, 1 gene cluster relating to siderophore formation, 6 gene clusters relating to the formation of polyketide lactone or lactam compounds (type I polyketide synthase is related), 2 gene clusters relating to the formation of aromatic polyketide compounds (type II polyketide synthase is related), 1 gene cluster relating to the formation of other polyketide compounds (polyketide synthase other than the type I and type II polyketide synthases is related), and 8 gene clusters relating to the formation of peptide compounds (nonribosomal peptide synthetase is related). The sequences contained in respective gene clusters are shown below.

(1) Gene Clusters Relating to the Formation of Melanin Compounds
  i) The ORFs shown in SEQ ID NOs:1125 and 1126 were present in the Mel1 (tyrosinase related) region.
  ii) The ORFs shown in SEQ ID NOs:5345 and 5346 were present in the Mel2 (tyrosinase related) region.
  iii) The ORFs shown in SEQ ID NOs:5133 and 5134 were present in the Hpd (hydroxylphenylpyruvate dioxygenase related) region.
  iv) The ORFs shown in SEQ ID NOs:2821 to 2830 were present in the Spp (type II polyketide synthase related) region.

(2) Gene Clusters Relating to the Formation of Terpene Compounds
  i) The ORFs shown in SEQ ID NOs:1008 to 1014 were present in the Crt region.
  ii) The ORF shown in SEQ ID NO:77 was present in the Terp region.
  iii) The ORFs shown in SEQ ID NOs:1638 to 1643 were present in the Shr region.
  iv) The ORFs shown in SEQ ID NOs:2151 to 2153 were present in the Geo region.
  v) The ORFs shown in SEQ ID NOs:2986 to 2988 were present in the Ptc region.

(3) Gene Clusters Relating to the Formation of Siderophore Compounds
  i) The ORFs shown in SEQ ID NOs:5252 to 5256 were present in the Sdf region.

(4) Gene Clusters Relating to the Formation of Polyketide Lactone (or Lactam) Compounds
  i) The ORFs shown in SEQ ID NOs:7337 to 7341 were present in the Pks-1 region.
  ii) The ORFs shown in SEQ ID NOs:1539 to 1542 were present in the Pks-2 region.
  iii) The ORFs shown in SEQ ID NOs:2263 to 2272 were present in the Pks-3 region.
  iv) The ORFs shown in SEQ ID NOs:7163 to 7168 were present in the Pks-4 region.
  v) The ORFs shown in SEQ ID NOs:2353 to 2356 were present in the Pks-5 region.
  vi) The ORFs shown in SEQ ID NOs:101 and 102 were present in the Pks-11 region.

(5) Gene Clusters Relating to the Formation of Aromatic Polyketide Compounds
i) The ORFs shown in SEQ ID NOs:3637 to 3653 were present in the Pks-8 region.
ii) The ORFs shown in SEQ ID NOs:2359 to 2376 were present in the Pks-9 region.

(6) Gene Clusters Relating to the Formation of Polyketide Compounds Biologically Synthesized with a Synthase Other Than Type I and Type II Polyketide Synthases
i) The ORFs shown in SEQ ID NOs:7109 and 7110 were present in the Pks-10 region.

(7) Gene Clusters Relating to the Formation of Peptide Compounds
i) The ORFs shown in SEQ ID NOs:3179 to 3190 were present in the Nrps-1 region.
ii) The ORFs shown in SEQ ID NOs:3621 to 3635 were present in the Nrps-2 region.
iii) The ORFs shown in SEQ ID NOs:3143 to 3152 were present in the Nrps-3 region.
iv) The ORFs shown in SEQ ID NOs:7142 to 7145 were present in the Nrps-4 region.
v) The ORFs shown in SEQ ID NOs:6586 to 6611 were present in the Nrps-5 region.
vi) The ORFs shown in SEQ ID NOs:595 to 603 were present in the Nrps-6 region.
vii) The ORFs shown in SEQ ID NOs:825 to 859 were present in the Nrps-7 region.
viii) The ORFs shown in SEQ ID NOs:1238 to 1241 were present in the Nrps-8 region.

Among the ORFs of the gene clusters relating to the formation of polyketide lactone (or lactam) compounds by type I polyketide synthase and the gene clusters relating to the formation of peptide compounds, the regions encoding a polyketide synthase and a nonribosomal peptide synthetase are considered to be multifunctional polypeptides. It is possible to estimate functional domains existing in the polypeptides by examining consensus sequences of respective functional domains of the polyketide synthase and nonribosomal peptide synthetase (*Science*, 252: 675 (1991), *Pro. Natl. Acad. Sci. USA*, 96: 9509 (1999), *Chem. & Biol.*, 6: 493 (1999)). Functional domains of ORF estimated to be a polyketide synthase are shown in Table 1, and functional domains of ORF estimated to be a nonribosomal peptide synthetase and deduced amino acids to be activated are shown in Table 2.

TABLE 1

Functional domain constitution of type I polyketide synthase

| Peptide | Module | Functional domain | | | | | |
|---|---|---|---|---|---|---|---|
| Pks-1_1 | Module 1 | KS | AT | | | ACP | KR |
| Pks-1_2 | Module 2 | KS | AT | | | | |
| Pks-2 | Module 1 | KS | AT | DH | KR | ACP | |
| | Module 2 | KS | AT | DH | KR | ACP | TE |
| Pks-3_1 | Loading Module | KS* | AT | | | ACP | |
| Pks-3_2 | Module 1 | | | | KR | ACP | |
| Pks-4 | Module 1 | KS | AT | | KR | ACP | |
| Pks-5 | Loading Module | KS* | AT | | | ACP | |
| | Module 1 | KS | AT | DH | KR | ACP | |
| | Module 2 | KS | AT | DH | KR* | ACP | |
| Pks-6 | Module 1 | KS | AT | | | ACP | |
| Pks-7 | Module 1 | KS | | | | ACP | |

Description of abbreviations of functional domains:
ACP: acyl carrier protein
AT: acyl transferase
DH: dehydrogenase
KR: β-ketoacyl-ACP reductase
KS: β-ketoacyl-ACP synthase
TE: thioesterase The remark * indicates that the domain is considered to not function due to substitution or deletion of amino acid in the consensus sequence region.

TABLE 2

Consensus sequence of amino acid adenylylation domain of nonribosomal peptide synthetase and activated amino acid and domain constitution

| Peptide | Consensus sequence of adenylylation domain* | | | | | | | | Estimated substrate | Domain Constitution*** |
|---|---|---|---|---|---|---|---|---|---|---|
| | 235 | 236 | 239 | 278 | 299 | 301 | 322 | 330 | | |
| Nrps-1_1 | D | F | W | N | V | G | M | V | Threonine | C-A-T |
| Nrps-1_2 | D | A | W | L | L | G | A | V | Leucine | C-A-T-E |
| Nrps-1_3 | D | V | W | H | V | S | L | L | Serine | A-T |
| | D | G | T | L | T | A | E | V | Tyrosine | C-A-T |
| Nrps-2_1 | D | A | Q | E | L | A | V | L | Glutamine | A-T |
| Nrps-2_2 | D | A | W | L | Y | G | L | V | Leucine | C-A-T-E |
| | D | L | P | K | V | G | E | V | Asparagine | C-A-T |
| Nrps-2_3 | D | V | W | N | L | S | L | I | Serine | C-A-T-E |
| | D | L | P | K | V | G | E | V | Asparagine | C-A-T-E |
| | D | L | P | K | V | G | E | V | Asparagine | C-A-T-Te |
| Nrps-3_1 | D | M | E | L | L | G | L | I | Ornithine | C-A-T |
| Nrps-3_2 | nd | nd | nd | nd | nd | nd | nd | nd** | | E-Te |
| Nrps-3_3 | D | V | W | H | V | S | L | V | Serine | A-T |
| Nrps-4 | D | L | T | K | L | G | E | V | Asparagine | A-T |
| Nrps-5 | D | V | Q | L | L | A | H | V | Proline | A-T |
| Nrps-6 | D | V | Q | L | I | A | H | V | Proline | A-T |
| Nrps-7_1 | D | F | E | T | T | A | A | V | Valine | A-T |
| Nrps-7_2 | D | A | K | D | L | G | V | V | Glutamic acid | A |
| Nrps-7_3 | D | F | Q | L | L | G | L | A | Pipecolic acid | A-T |
| Nrps-7_4 | D | A | F | W | L | G | G | T | Valine | A-T-C |
| Nrps-7_5 | D | A | Q | D | L | G | L | V | Glutamic acid | A-T |

TABLE 2-continued

Consensus sequence of amino acid adenylylation domain
of nonribosomal peptide synthetase
and activated amino acid and domain constitution

| Peptide | Consensus sequence of adenylylation domain* | | | | | | | | Estimated substrate | Domain Constitution*** |
|---|---|---|---|---|---|---|---|---|---|---|
| | 235 | 236 | 239 | 278 | 299 | 301 | 322 | 330 | | |
| Nrps-7_6 | D | F | Q | L | V | G | V | A | Pipecolic acid | C-A-T |
| Nrps-7_7 | D | V | W | H | V | T | V | V | Serine | A-T |
| Nrps-7_8 | nd | nd | nd | nd | nd | nd | nd | nd** | — | T-C |
| Nrps-7_9 | nd | nd | nd | nd | nd | nd | nd | nd** | — | C |
| Nrps-7_10 | nd | nd | nd | nd | nd | nd | nd | nd** | — | C |
| Nrps-7_11 | D | L | Y | N | L | S | L | I | Cysteine | A-T |
| Nrps-7_12 | nd | nd | nd | nd | nd | nd | nd | nd** | — | T-C-T-Te |
| Nrps-7_13 | nd | nd | nd | nd | nd | nd | nd | nd** | — | T-C |
| Nrps-8 | D | L | V | F | G | L | G | I | Alanine | A |
| Nrps-9 | D | H | E | S | D | V | G | I | Cysteine | A |

*Numbers from the N-terminal terminal, based on the amino acid sequence from Grs (gramicidin synthetase) nonribosomal peptide synthetase adenylylation domain.
**Known consensus sequence cannot be found or no adenylylation domain exists.
***Description of abbreviations of functional domains:
C: condensing enzyme
T: peptide carrier protein
Te: thioesterase
A: adenylylation enzyme
E: transferase

EXAMPLE 6

Retrieval of Genes Effective in Improving Avermectin Production and Reconstruction of Avermectin Productivity-Improved Strain Based on Genome Information:

(1) Retrieval of Genes Effective in Improving Avermectin Production

S. avermitilis ATCC 31267 (wild strain) and an avermectin-high-producing mutant obtained from the wild strain by repeating many steps of random mutation and selection using a mutagen N-methyl-N'-nitro-N-nitrosoguanidine were cultured using an avermectin production medium, and intracellular proteins and the full RNA of transcription products 24 hours and 48 hours thereafter were compared. As a result, it was observed that the transcription quantity of some mRNA's was different, and when the result was confirmed once more by changing the production medium, it was revealed that the expression quantity was changed in two genes among them. When partial sequences of cDNA fragments of the two mRNA's were examined, they were SEQ ID NO:3692 and SEQ ID NO:923. The ORF of SEQ ID NO:923 was identified as a regulator gene existing in the avermectin biosynthetic gene cluster. On the other hand, SEQ ID NO:3692 was a novel ORF. Since the mRNA corresponding to SEQ ID NO:3692 was detected only in a small amount from the avermectin-high-producing strain, it was considered that the gene product of the ORF is a repressor for avermectin production in S. avermitilis.

(2) Reconstruction of Avermectin High Production Strain

It was considered that production of avermectin was increased in the avermectin high production mutant obtained from S. avermitilis ATCC 31267 by repeating many steps of random mutation and selection using a mutagen N-methyl-N'-nitro-N-nitrosoguanidine, due to reduced expression of the gene product of ORF as a repressor shown in SEQ ID NO:3692. Thus, improvement of avermectin production can be expected by disrupting the ORF represented by SEQ ID NO:3692 in the wild strain.

The ORF moiety shown in SEQ ID NO:3692 and its upstream and downstream moieties were amplified by PCR from the chromosomal DNA of S. avermitilis ATCC 31267 to produce a DNA fragment in which a resistance gene was arranged in almost the center of the ORF, and a disruption strain was produced by allowing the fragment to cause homologous recombination with the same region of the chromosome of the wild strain. For the amplification of the upstream side of ORF of SEQ ID NO:3692, primer 1 (5'-CTCGAGGATCCGAGCGCTTCAG-CACGTCGGAGATGGTT-3'; SEQ ID NO:15106) and primer 2 (5'-CTCGAGAAGCTTCACCCAGATCACCAG-GTTGTCGCCCTCG-3'; SEQ ID NO:15107) were used and the chromosomal DNA of S. avermitilis ATCC 31267 was used as the template, and 0.2 U of Expand Taq DNA polymerase (manufactured by Boehringer-Mannheim) was added thereto in the presence of dATP, dGTP, dCTP and dTTP to carry out denaturation at 96° C. for 5 minutes, followed by 30 cycles of the reaction, 1 cycle of the reaction at 98° C. for 15 seconds and at 70° C. for 60 seconds, to thereby amplify a fragment of 1861 bp. On the other hand, for the amplification of the downstream side of ORF of SEQ ID NO:3692, primer 3 (5'-CTCGAGAAGCTTGGAGCCGTACCCGT-TGACGATGAAGGACC-3'; SEQ ID NO:15108) and primer 4 (5'-CTCGAGGATCCATCTGATGCCGTCCT-TCGCCATGCC-3'; SEQ ID NO:15109) were used and the chromosomal DNA of S. avermitilis ATCC 31267 was used as the template, and 0.2 U of Expand Taq DNA polymerase (manufactured by Boehringer-Mannheim) was added thereto in the presence of DATP, dGTP, dCTP and dTTP to carry out denaturation at 96° C. for 5 minutes, followed by 30 cycles of the reaction, 1 cycle of the reaction at 98° C. for 15 seconds and at 70° C. for 60 seconds, to thereby amplify a fragment of 1656 bp. Each of the amplified fragments was digested with BamHI and HindIII, the 2 fragments were mixed with pUC19 which had been digested with HindIII, and T4 DNA polymerase and ATP were added thereto to ligate the 3 fragments. The thus ligated product was introduced into Escherichia coli DH10B, and the transformant of interest was selected using LA medium containing 0.1 mg/ml ampicillin. A plasmid DNA was extracted from the transformant, partially digested with BamHI and further ligated to a BamHI fragment of 1.95 kb containing a streptomycin-spectinomycin resistance gene (aad3"). The ligated product was introduced into *Escherichia coli* DH10B, and transformants were selected using LA medium containing 0.1 mg/ml ampicillin and 0.1 mg/ml spectinomycin. A recombinant plasmid was extracted from each transformant and digested with EcoRI/HindIII to select a clone in which the streptomycin-spectinomycin resistance gene (aad3") was arranged not in the BamHI cloning site of the vector but in the center of the cloned fragment. A plasmid DNA was extracted from the transformant of interest, a HindIII fragment of 5.47 kb which had been cloned by digesting with HindIII was cut out and ligated to the HindIII site of pKC7. The thus ligated product was introduced into *Escherichia coli* DH10B, and the transformant of interest was selected using LA medium containing 0.05 mg/ml kanamycin, 0.1 mg/ml ampicillin and 0.1 mg/ml spectinomycin. Since *Streptomyces avermitilis* restricts methylated DNA as described above, a plasmid DNA was extracted from the transformant obtained above to transform a dam and dcm defective *Escherichia coli* GM2929. Using a methylation-free plasmid DNA obtained from the transformant, protoplasts of *Streptomyces avermitilis* ATCC 31267 were transformed by a polyethylene glycol method, spread on a regeneration medium and then cultured at 30° C. Twenty hours after the culturing, soft agar containing 0.1 mg/ml neomycin was layered over the medium in an amount of 2.5 ml per one plate, and a transformant was selected by continuing the culturing for 7 days. Transformants grown on the selection medium were collected, spread on YMS agar medium (4 g/l yeast extract, 10 g/l malt extract, 4 g/l soluble starch, 20 g/l agar, pH 7.5) and cultured at 30° C. for 7 days. Spores formed on the surface were scraped, spread on the YMS agar medium to give a density of 200 colonies per plate and cultured at 30° C. for 5 days.

After confirming formation of spores, colonies were replicated on two media, namely YMS agar plate medium containing 0.1 mg/ml spectinomycin and YMS agar plate medium containing 0.002 mg/ml neomycin and 0.1 mg/ml spectinomycin, and cultured at 30° C. for 5 days. Among colonies grown on respective plates, homologous recombinants which formed double crossover recombination event showing neomycin sensitivity and spectinomycin resistance were selected. Each of the recombinants having insertion mutation in the chromosomal ORF shown by SEQ ID NO:3692, caused by homologous recombination, was inoculated into a 100 ml-conical flask containing 10 ml of a production medium (46 g/l glucose, 24 g/l peptonized milk, 2.5 g/l yeast autolysate, pH 7.5) and cultured at 28° C. for 7 days under shaking.

After completion of the culturing, 10 ml of methanol was added thereto, followed by shaking for 30 minutes to extract the cultured product. The cell residue was removed by centrifugation at 3,000 rpm for 5 minutes to obtain supernatant. Amount of avermectin contained in the supernatant was determined using an ODS column (4.6φmm×250 mm; moving bed, methanol:water=80:20). It was found that about 5 μg/ml avermectin was accumulated in *S. avermitilis* ATCC 31267, while about 28 μg/ml avermectin was accumulated in the recombinant in which the ORF shown in SEQ ID NO:3692 had been disrupted.

As is demonstrated by the reconstruction of avermectin productivity-improved strain, the present invention provides an effective and novel breeding method for obtaining industrially advantageous strains by excluding disadvantages of conventional mutation breeding. The methodology for reconstructing producer strains by reconstructing effective mutation is an approach which can be carried out efficiently by using the genomic nucleotide sequences disclosed by the present invention, and its effectiveness was found for the first time by the present invention.

While the invention has been described in detail and with reference to specific embodiments thereof, it will be apparent to one of skill in the art that various changes and modifications can be made therein without departing from the spirit and scope thereof. All references cited herein are incorporated in their entirety.

SEQUENCE LISTING (15109 sequences)

SEQ ID NO: 1 - DNA, 9025608 bp, Streptomyces avermitilis (residues 1-1,805,122 of 9,025,608)
  misc_feature (4187715): a, t, c, g, other or unknown
cccgcggagcgggtaccacatcgctgcgcgatgtgcaagcgaacacccgcgctgcgcgcgggtgttgcgctcccgctccgcgggagcgccggcgggacgctgcgcgtcccgctcacctcggttgctgcgcaaccggggtgacgctccgtccgctgcgctcccggagcagtgtgggctacgcccacgcgaggtagcttccgctgcgctccagctacaagtggcgctgtgcgccaccaaagccggcatcgctgcgcgaagccggccaacgggccttgcggcccgggcggcagctaggtgggccgcctgcgtcgtgcagaccggttggctaccagcagccagatccacacgagaaccatgccggctgacaccaggatgcggcctgtgccatcaccatcgactatccgccacaccagcaagccgatgcccaggcagagcatcggccagtaaagccacggcccccaactgttgcccggcctcgcccatgacggcggaacgtagggctcggagcgtttcctcatgcgcgccccctccttccttgcctgcagctgccatcaagcgcgcctctccccgggctagatgccgaggcgggcagtctggcttccgatcagatctgcgccaccaatatccatgtggcgatcgccaggaagagcacccccgtaacccgctgcatggcgtaccccttactggtgggctcggtcgcgtccgggtccttcacccatccccgctgaaggttcctgttcgccttccagagcagttgcggacgtgtgacttgaatgaaccccatgatcagcaaggcgcacaagatcgggatgaaaaccggactgccgccgccatcggaggcagcctccattaccgcatcgcgattcatgcatctgcggatgccctgacatcgcctcagataacggacagcgccccctcggcggatccacttgcttctccgccgccccacgatccttccggctgcgcctccaggagcggcggcccgccgacacgggcaaggctgggtgcgaggggtgctcgtgactatcgggctcaggcgttcgcgtggcgagaggcgaatgcctgtcgcggtgcagcgtgatgcgccggcctgtttgctgtggcggcctggaggcgcctcagccacagggaggccgtgaacagcaggccggtgaacaccgccaggagaagtacggagacccacatctgccggcttgcgggatacgcccatcccgtccaggccgcggcggccgcccacaacaggacccctaccgcgtagaaggcacggacctgacgcagctggcgctcggcccgcagggacatgaggtgatcagtcttgggtgccatgccggcccgtgtaccccgaaccgcgctatccagtgggcttcgtttgatgcccttcaggtttcgctgcccggcttccatggcctaccagccggttcgggcggctgaggaccatccagggcgctgcggagtttctccttgaagcttttcggcggggcctccttctcttcctgtgtatgcatgagccgggcagtggtcacccgtatgtgacactcgcggtgccgctgcctgaggagcaccagccaggccccgtcctgggtgaggaaagcatgccgggccggttcgtctcccggtcgggcatgccgagcgagcactcccggcatgtagttcagggccgcatcctcggccgcggcggcggcctgttcctgatctcctgcgatgtgctgagtggccgccagtttccagcggtgcaatctgagttcaacgccgtcggcgcgcttggtctctcgtgtgtcctcttcgacgaggacgtaccactcggcggtcatggcgggagcctatcttccctccactggccgaaccgcgaccagccgattgatgcagcatgtagagttgacgaaaatgtaggacaccctcaccgcttggacggtgcgcagcgcaggccgtccagaaaagggaagccgtatgtggcctgctcgggatgtgccgcgggatcgggtccggcgtcaggcaaatagcctggacggtgccgttgcgcagcgggtcgcaaaagccgctgcgcgtgagcgtgagacagcggatcagtcgcggcggggcgattccttctcagagttcgagagggacccggagcggctggctgacacctgggcggccaagcatgtggagtggcggcgcgtcagggactcgacggctgcagccggcttggcgcgtacgaggcgagacaggggatccagggctcggactgggctcgggagcacgaagatcagagttcaggtcctggcgccacccgccgagcggggcatggtgggcgaaagacggtacggtgtccgtccctttctttacaccgtcccggtgatttcctgcaacggtcgtagatagagcttgaggaggggcactaaatgcggggtattcaactccgggaacatcaggtcgaccagaaggctagtttccgttagtgggtcggattctctgcaaggtcatctgtgccccctcagggagcccgtggcacgatcgtgtcagctaccgggtccggcaaaacgagcatggccgccgcgagcacgctgaactgcttccccgaaggccggatcctcgtgaccgtgccgaccctggacctgctcgcacagaccgcccaggcgtggcgggcagtcggccaccactcccccatgatcgcggtgtgctcgctggagaacgacccagtgctgaacgagcggacctgacgcccagcgccgcccatgaaccacctctggctcggtgcaccgactaccggcactaccgtcggatcatggactggaacttccccgacgacgacatcttcttctgcggcgggtgcggcgacgacgacacccccgacccgcgggtcccgcgtcaggacaaggccctgtgcgtccgctgcgacagagtcgaacggcaggtccgccgataccggatcaccgtgccgcggaggaacgcgatcatgcgcttccagcgcgacgtctgcgccctgtgccaggaaggcccgccgaccgaccactgccccgatgccgtcagcttctggcacatcgaccacgaccaccgctgctgccctcccggcggctcatgcgggcggtgcgtccgcggcctcctgtgcctgccctgcaacgccacccgcctgcccgcctacgaacgcctccccaacgtcctccgcgacagccctcgcttcaacacctacctcaacagcccacccgcccggcaccccgaagcccgccccaccgccagggaccatgcaggcccccgcgacgcatccagctacctcatcgacgcctttttcaccgccgcggaccatcccgaggggaacgccctcagctcctgaacgccgctgtcctcccgggcggcggccggcagccacggggcttggttcgggctcgcgacgttcgccgtcctgagcgcaaggccagaaaagcgtccttggcgagcagcagggcgcggtggcggtcatgccgcagctgctgcgccagccgatccgaagacgtcgtcgaagcagtgtgcttgctccgtgcgtacgaggtggaaggcaccgctgcggtggcgcaaggcgtgagcggtgtagtggaccacctccgccggcgtgaggaccttcaggtcgccgaagacgtagtacagcggagtcggagcgtgggccgcggtgaaaaagaggccggcggtcacggtgtcggcgctgacggcgtagcggtcggtgtcggtgctgggcatgcggtccttggcgtcgatggtgatcaggtcggcgccgcgggcggcgatgaggtcggggaagtgccgcagggcggagcgggtccggcgcagggcttcccgtacggcgggcgggtaggtgccctgtccgcagggctggacggtccagccgcgggcgcgcagcgcggccgccacccgacgttcgtgcatgtcgcctatcgcctggcggtcctgccactgcgtcactcgggttccccctggggtaagtgccacgatccctgtgcgtgatacgaaggattcatagttcgtcctaccctcctgaaggctatgatgctcctcatggcggcatacgttgacccacgctttcgtcctacgctatggcctggaacgcccgtgccgacaccggagttgatgcctcttcgcggagcgcgggccgacggtgaatggatcgtctggaccccgcaggtccgctcccgctcgcacacggtccccgtgccggaggacttctacctgcgcgagttcatggaggtcgaccctgaggacctcgacgccgtggccgccctgatgggcgcctacggacacctcggcgggagcatcaacaccggaagctgggacgtcgacgtctacgagcgcctcaaggagctcacggagcgcgaacacccccgcgcgccgttcgccctgcacggcgaactggccacgctgttcatgagggaggcgcaggcggccatcaccacctggctggccctgcgccgcgagggcgggctcgacgcgctcatcgagcccgaggtgtccgaggaagaactggcgcagtggcaagcgagcaacgctgatcttgaggaagcgtggccgcgggacctggaccacctgcgcgaactctccctggagatcaggatcagcaacctcgtgagcgaactgaacgccgcgctgaagccgttcagcatcggcatcggcggcctgggcgaccgctaccccaccatcctcgctgtggcgttcctccagctctacaaccacctcgccgaggacgccacgatccgcgagtgcgcgaacgagacctgccgccgccacttcgtacgccagcgcggccgcgccgcatacgggcagaaccgcaccagcggcatcaagtactgcacccgcgaatgcgcccgcgcccaggcccagcgcgaacaccgccggcgccgcaaacagcagaccacgaccctccagcagccgccggcgcctggtcctcagtctcacgacacctcagagccgactgccgaagggcgctgactgatgatcagcctgcgagaacaccaggtggaagcgaacgcgcgcatccgggcgtgggcgggattccccacgaggtcaccggtaccggcgcaagggctgcgcgggaccgtcgtctccgcgaccggctccgggaagacgatcaccgccgcgtgggccgcacgggagtgcttcaggggcggacggatcctcgtcatggtccccacgctcgacctgctcgtgcagaccgcccaggcgtggcggagggtcggccacaacgggccgatggtcgcggcctgctcgctggagaaggacgaggtcctggagcagctcggcgtgcggaccaccaccaaccccatccagctcgcactgtgggcggggcacgggccggtagtcgtgttcgccacgtacgcctcactcgtagaccgtgaggatcccgaggacgtcacgggccgggcgaaggtacgcggtccgctggaggccgctctggccggcgggcagcggctgtacgggcagacgatggacggcttcgacctcgccgtcgtcgacgaagcccactcaaccaccggtgatctcgggcggccgtgggcggcgatccacgacaacagccggatccccgcggacttccggctctacctgaccgcgaccccgcgcatcctcgcctccccccgcccgcagaagggcgcggacggccgggagctggagatcgcgacgatggccagcgaccccgacggcccttacggtgaatggctgttcgagctcgggctgtcggaggccgtcgagcggggcatcctggccggcttcgagatcgacgtgctggagatccgcgacccctcccccgccctcggggaatcggaggaggcgcagcggggccggcgcctggcgctgctgcagaccgcgctcctggagcacgccgccgcgcgcaacctgcgcaccgtcatgacgttccaccagcgggtcgaggaggccgccgcgttcgcgcagacgatgccgcagacggcagcccggctctacgaggccgaggtctccgccgaggccctggtcgacgccggggccctgccggagtcgtcgatcggcgcggagttctacgagctggaggcaggccgccacgtacccccggaccgagtgtgggcggcgtggctgtgcggtgaccacctcgtcgccgaacgccgcgaagtcctgcgccagttcgcagacggcctcgacgccggcaacaagcgcgtgcaccgggcgttcctggccagcgtgcgggtcctgggcgagggcgtcgacatcgtcggcgaacgcggtgtggaggcgatctgcttcgccgacacccgcggctcccaggtggagatcgtccagaacatcggccgggccctgcgcccgaaccccgacggcacgaacaagaccgccaggatcatcgtgcccgtcttcctccagcccggtgagaacccaaccgacatggtcgcctccgcctcgttcgcacccctcgtaaccgtcctccaaggcctgcgctcacactccgaacgcctcgtcgaacagctcgccagccgggcgctgaccagcgggcagcggcacgtgcatgtgaagcgggacgaggacgggcggatcatcggcaccaccaccgaaggagagggcgggcagcacgagagcgagggcgcagtcgagtcagcactgctgcacttctccaccccgagggacgcgacgacgatcgcggcgttcctgcgcacccgggtgtaccggcccgagtcgttggtgtggctggagggctaccaggccctgctccgctggcggaaaaagaaccacatcaccggcctgtacgccgtcccgtacgacaccgagaccgaggccggcgtcaccaaggcattcccgctggggcggtgggtccaccagcagcggcgcacctaccgtgcgggcgaactcgatccccaccgcacgaccctgctcgacgaggccgggatggtgtgggagcccggcgacgaagcctgggagaacaaactcgcggccctgcgctccttccaccgcgcccacggccacctcgcccccagacgcgacgccgtatggggcgacgccgacagcgaactggtcccggtcggggaacacatggccaacctccgccgcaaggacggcctcggcaagaacccgcagcgcgccgcaacgcgggccacgcagctggccgcgatcgaccccgactggaactgcccctggccactggactggcaacgccactaccgcgtcctggccgacctcgccaccgacgaaccccacagccgactccccgacatccagcccggcgtgcaattcgaaggagacgacctcggcaaatggctccagcgacaacgccgcagctgggcggaactctccgaggaacagcagcaacggctgaccgcgctgggcgtaacacccgccgaaccgcccacaccgaccccgtccgcgaagggtggggggaaggcagcagccttccaacgcggtctcgcggccctcgcacagtggatccagcgcgagggcgcccacaaggtagtaccaagaggacacgtcgaagccgtcgtcatcgacggccaggaacaccagcacaagctcggcgtatggatctccaacaccaaaacccgccgcgacaaactcacccacgaccagcgcaccgcactcgccgcactcggagtcgagtgggcttagcagcagggtctgcctcagcggttggtgttctcctctcggatcatccgtcggaggctggtgcgtgctgccgccaggtctgtttccagggtgcccacgcgagccggtggttgtcgtcggtggcctgctggaggctgtcttcgagccgttggttgttccgggtgagttcgtcgacgcgttcggtcaggtgcccggtgtcgagggcgtcgagttgctgcccaagctggcgtttccgtgagcaccgacgcactcccccggacgcggccgtggcgccgtgggcggcgcagcagcccccgtatcttgccccgcaccagttcagtctcctgccgctgcccgaactgctgcgctgggaggtcctctacggtctgcagcaggtggacccgtggctgcggatcttcgaacctgcgcaggtccgccgcatggtgcgggacctggctgagaccggcacgctcatcgacggcatcagggaccagcagatgtgccctcgctccaccgttgcggtcttgcggatgctcggccgcgtgcgtacggcggtccgtgcgggccatgcggagtacaccggcaccgcgccggcacaggacgacgtcctggatctgcgtgcgctcggccagcgctcccgcaccccggccggtatccggcagcccaagaccgtcgatctgcgcaccatccggcagccgtggctgcgcggcctgctgcgtacctggaccgtccagcagcgcccgggagcggacgagttcgcccgcacgctgcgcggcgtggagctcgcctcccgggctctcgcgcagcgcccgggaaccgacgaccccgcaggcttgcgctacgacgacgtcaccgccgtggtcgacgcgatccgcacggcactgaaacgggacggcgaaccggccggctggaactaccgcatgtccatcgccagccactttttcgccttgatcgactacggccaccgctccggagccgcggacgacctctcggccgcctttgtccgtgaccccgccctccaccgcatccctgagcaggaggccaacgaggacgagatcggcaaggcgatccccgaaccggtgatccgccagctcgacgcccacctccacctccttggcctggggcgggcccgcggccagcgcaccctcgcccccgacgacctgcagctgatgtaccgcacgctgtacatcctgctcagagacaccggccaacggcccctggaagtcctctccctgccccgcgactgcctggagacccgcaacgaccagatctccctgatctggaacaaccacaaggcccgccgacaccgccgacgcctgcccatcaccacgtccaccgcccaggccatccgtacctggcaagaacgccgagaacagctccaggccagccttccgcccaccggcgccgactacctcttccccgccctcacccacctcgccacccgcccctacctgcacaccagctacctcggcgagaccctgcgcgactgggtcgactccatcccccacctgcacggcgaaggcaccgacacacagggcaacccactgcctttcgaccgctccctcatctacgcctacgccttccgccactcctacgcacaacgccacgccgacgccggaaccccactcgacgtcctgcgcgaactgatggaccacaagtccgtcagcaccacccagcgctactacaccgtctccctgaaacgaaaacgcgacgccgtcaccaagctcgccgcccacgtcgtcgaccaccacggccaccccagccccagctccgagaccgcctacgaactgcgctccgtcgccgtcccctacggcggatgcaccgaacccagcaacgtcaaagccgcaggcagctcctgccctatccgcttccagtgcgctggctgcggtttctaccgccccgacccctcctacctcccggcgatcgaacagcacatcaacgaactgcgcgccgaccgcgaaacagcccaggcgatggacgccgccgaattcgtcatcaccgccttcaccgcccagatcaccgcctacgagcaggtcaccgaccgtatgcagcgccgcctcgccgctctccccgtcgcagaacgctaggagatcgaggaggccagcaccatcctgcgcaaagcccgagccggcaacacccacaccctcctgccgctcaccgtcgtctccaggaccggcccggcatgaacccccgcggcaacccgcacaccctcgcccaggcccgccaccgcaccagcctcgacaaacgccagcgagccctgaccgcgctcaccaccctggaacaacagggcgaaaagatcactcacaccgcggtcgcccgcaccgccggcgtctccacatggctcacctacgctgaaggcatccgcgagcacatcgaagccgcgcaacaacgccagcaccccaccaccccctcgcccgcccgcacccgcagcaccaccgccacgctgcgcacagaactcgagctcgccaggcaggagatccggaccctgagggaagacagagaccggatgaggaaggccatccagcgctgcgcatgatgccggcacaggccccggccgtacaggcccggcagcgggcaggcgggagccgggcaggcaggggtatcagcatacgggacggcggtgtcctcccaccggccggcggtcttgcgggtggaatgggttttccactgggtgtagtgcgtggcgcacagttccttgcagtggcggggccggacacagcgctgcccgtccttcgtgaaactgcacggctccggaacaccaccgaaggcaacgcggttacgcaccggcacgaaggcccgcgcgaactccgcgtcgggcagcggcgaccgtttctgctcctccttgcagaaagggcagaagatgttggccggtgagaccacggtgtcgcacgcctcggtacggcacagcgcaaccgagctgcgcggctcgtggacactgccggtgaacagccagcagtcctgccgccattcactggtccgccaggcgggatcgagatgacctcgcagccacgcagcccatcccccgccgtcgagatcccccgcgttttcggcgcgcggtgcgggcagccgcgacagtgcggacgagatgctgctcatcggcgctccttcagagaaccgacgcgttcgaccgctgcccgtgcctcggcgtcgttgacgtgccggtagcgctccatcgacaacggggaggcgtggcccaggagccgctgcaccacatcgcggtcgacgccgtcacgcagccagcgggtcgccgccgagtgacgcagcatgtgcggacgacgcgcatgcccgagagcaacgacgccaaaaaagccaccgcctccgcctgcagatcaaacgaaccggcgtccaccaccacccaccgcaccacaccgggcaccggagaaacagcacgctccgccacaaattcggcatccacgtgacaaacacaaccaccgcccgcagaacggcgtacggcacacgctcactggccatccccgcaggcgacaacccaaacaaacatcccccaccgctggctcgccccgagataactctcggcggggccaggaccaggggtcagtggggtcagcgctcgttttccaaagcagcggtcaacccgtaggcacctgcttgcgagagcctgtcgatgacgtccaggcaacggatccgttcggcctgccggctttgccgatagaggcggaggactgccgagaccaggtggtggccgtccgccgcacgatgggttctgaggtcgccgagctccctgcccgcgtgctgaacgatgcgttcgcaggcatcaatagcgacagtgggaagggggccagcgtggtcgtagagagcgaaggccagatgttcgaggtggtcggggaacgccttgccatcgaggaacgctctgacgagttcgtcggcttgcgcaggaaacaggtcgaacacctgccgcatgccctgggaggcgttctttcgcacgtcggcgtcatcgtcgttgaacagcgggacaaggtgcgggtagtggtcgatgttgtcggcgaagaccgatgcagccccacggcgggcgagggcgttgagttcatccgtgctgttcggaaggtcaggggtgaggcatccctggatggtggcaacagcccaggactggccggcaagttcggccgtatcgcccggcccttggagggctcgagcgaggtgggcagcgaaacgtgacggttcacggaccagtatgttgatgagcagccgttgagtggtggaggcgttgtaggcattggcgtcctggtggttcaggagttgctcggtggtgtccagcgcaatctgagggtcatgcttcatcaaggccagcacggcctgggcggcacagactcggacagcgagcacagagtcgttggcgaggcgggtgaccaggggtgtcaaggcgtgcaggtgctcactgccgtggaagagcagggctgcaacggtgagcgctgcctggccgcgggtggcgttcatgccggcggtcagcagatccgttcgggttccctcggcatcggcgtcgcggatgtcctgctcggggtgggggtccgtggtgtagctgtcgagggctggcagcgaagcagcagtgaagttctgcggcgccgactgcagggcgcggcagatcgtgggcgcggcggcggggccgaggatctggtgagtgtggagagccaactgctcccaacggtcggcgtccagatgaggcgtgaccgctcccacgatcgcgcacaggtaggtggctggtgcgtccgggccaagcgtgaaggcgaagtcggtaaagcgctcgggttcctgctccgcgcggctgcccagggtctgagcaagttcgtgaacgcccccctgaggcggccagaaccgctcggcctggggcttggcgtacatgttcagagctcggtgccactgttcattggtcatgtgccgggccgcatggtcactgatcggcgagccgacgaacccagtctggattggtgtcggtggcgacgggacctggccagggaacttgcgttcccattcggcgagtcggcggcatcccgcgtcgctacggcgcgaggggcagattgccgacagcagctcgtactggctccagccccaggcgctgtgctgccccttctgccgtcggtgttcccacgccgggtagtagtcgagcagcatcgcggtcagacgttccaacgtctcgtcactgcagtgaggcgtggttgcctcgatgagttcacgcgaggcccagcgcgcactgctcagccagcccaggcgcaggttgcgttcatcgttcaggagccaggcgatcgcctcgtctgcctgattcatgacggcgtagacacggcaggcgaggaagcgcagctcttgaaccggtgagggagtcagttgctgcaaggcgtccgcagcggcagccggggagttggcagccagggagcgcagtgcagtgtcgagggcggtcagcagtgcagcgtcgacgccgtggccgcccacaaggcggtgagcccaacggccgctgggggcataggcgtcggtgccccccgtgctgcctgccgtagccacgtcgatgacaaagggcaggacctggctcacgtaggcttccggctcggcctccgcgatgcgggagaggaccgtgtcggcaaactgggaatgcgttgacaagtgcccggattcgaaggggtcgccggagtcatcggcgcgcgctcgggcaaggtgacgccacagataggcgcctacaaggcgcgcagcgggagcgggagcggtctcggccaaaccgtagaggagtgaccagaagtcactgttcaccgcgatgggtccacgcgcctcgtccgcatgtccgctctcgatcaggtcgacggcgaggtcaataaggccgggtgtgagcgcccactcaatcagccgcagaagccgctgtccccactgtggcgtggtgcccgcatacggtcgtaccagctccgcaacacggctcgggtcggtggcgcgcgacggccagcagttcagggaacgcagcatcggcggtccgcggcgtgcccagccagcgttcccacctctgatcgtggtcggcggcgtcgaaccactgcggcagggcgagcagacctcgtaccttgcccgccacaggcgtctgaccccaagcgaccggttcgacggccttccagtcaggcagcgcggcatcgaactgcccgaggaccgcgataatcacatcatgcaggtgcgggcggatccggtcggagcccagaagccggcccactgtggcgcggaaacgttcagggtctgtgccagcaaggtgttcgaggatctgccgggtctgggcgcgacggaacaggtactgacctgagttggccaggaactcgtggatgtcctctccggcggagatgaaggaccgggcgaagaggaaatcgaagtaagtctcgtggaagaacccgatctgttccccgtcgcgcaccagcacaccgtgcgattcgagcaccttgatgtgctggcgggcaaaaccgtcgaggagagccatgggtgcctggagggtttcgcgttcgctcatggaggcgcacagcgtgcccgtgataccccgccagtccagtgcggcgacctgtcgctcgatctcctcgcgtcgttcatcggtgtagcgcgcgtacagctcctgcaaggtccggtaggaagcggcccgtgcggaggacgacagacggctgaagaccgacaggtgcaacggagtccgcaacagctccagcgtcaccggccccaagccgtcgggatccgtcccgctggcggacagcacagcccgcacctgttccacgtccagcacgctgagggggaaccggactgtccggacgcggtcggcgaccaggtcggacagcctccggtcattgtcgatgtcgatggtgcgggccaccaggagcaccttgacgttcggggcgacgaccagctgtgcgagtacgtcctccacggcctcataggcatccgacatcctgccgttgtaggtgctgaccgcatccagctggtcaatcaccaacagcgccggcgcttcgtccgcgaccccagccagcagcaccgccggcgagtccggcagggtcatcctgacccccaggtccttggccgtctgcacactcgcgtcggcgccgtccatccggaccgcggccgccggccatccctgctcggtcagccggaccaggacgtcggtgacgaccgctgacttacccaagccagcgctgccctcgcagaccaccatctgcgggccgtcctcagccaccaggcgctcgtacagctgctccacatgcggacgagcggccatcccgaacgcgggcttgtcccgtcgcacgcgccgcacaaagcgctcgaccgtcccggccagggccgtgagcgtcccggtgtcacccgccagcagacgtgggcgcacccccggcacggttagaagatggctgcggatctgggagccggtgagacgctggtgcaggtgctcgtcgagatagccgctcagctgcctgacgatcacttccgggtccccgacaaacagcagctcatactcggagaccaccaggcggcgcagtgcctctggtgggatgtgctccacgtgcacggcctgcagataccgccagccgacctcccggtcgaccggcatcccgttgtcggaccagttctcgagtacctgtacaaactggggaatctgggccttggtgatcatgccctcgaactcggcgagtgtgtcggcgccccgggcccgcttagaaagatcatgcagttcaggggcccccgtggacagcacaaggcgcaccttcttgccccccgcaagatgccccgtgaccgcctcgaggatcttgcccgcagcgctcagggtccacggccccttcgaggggacgtccttcacctgctcgcaccaggtgccgtcgtccgcctcgagctcgaactcgatcccggcgcccgccggccccgggggttccagacgaatccccgtcgcccgcccccgcagcaactccgccaccctcagcgcggtccaccagtcctcgtaccggttacccgccttatccgcagccccacccgccagccccacccagcctcactcccccaggacattccatcggttctcaccctttcggaaccgcgccacgcgaccctactcccaccaactgacaaacactcagaacattacaaaacagccaaatcatgatcttctacaacttcaggctccaccacaactgtcggaccgcacggaagatttcagcgggcgtgactgtgacctgggcactgaaatcttccgtgcgacgccttggggtggcgctagcgcaccgatcgcttcaggtgaccgtgacgtctcttctcctcttgtcctgcgtggtgatggtcagcgctttacgcggctgcggacggcaaggacggccaggccgaggaggacgggttcggcaagccgggaggtcatctcggtgtaggtgccggtggcggtgaggtcttgtccggaggagcggaagatcactgaattgatcactacccgcagacccttctccagccgttcggtggtgacgcgttcagtcagtggaccggaggggttgaccggggcggggacgtcggtggtcaggaggacctcctgacctaccgcgacctggcggccggtggtggtcggcttcgggtcatcggcgggcaggccccacagcaccatcaccgcgatcgtggcggccatggccgccaccagccaggccagtgttcggatggcgcgcagcccgtacccggacagggcccagtaggcggtcagcagtgcccgttccccccagggccgcgtgacgtcatggcggcgcatctcggactcgccgtagtagaagtcggcagcgtccggctcgttcttgccgtcttccagcgactttcgcagttgccggtacagcgccgccaccattgccggcttcagcacgggggcgtcctgcggcgaggtccagccccgggcgacggcccggccggggcggcgggcggtacgcactcgccaatggtgttcctctaccagtgtgttgcgctggctcgacggccaggaaaagggtcggccccagccagcgggaacgccggcgaaagtgcaccagccgtccaccttcagctggtccaggtggacgactccggcgaaccggcaggcactcaggtcgatgtcctgcagcgccaggtgcgcggcatccaccccatccaccgacatcagacgcactccgggctcccggccggacagctctgcctccgacagcgagacagatactcggctccgaagggcgttcgggcgggcggcaactgtcacggggtactcgaagacagcgtccctcaggtccagctcggcgtagcgcagacgcagcgtggcggtcgatgcccaccgggtgcgcacacagctgacctgatgggcggcaatctccaccgtcaccggctgcccgaacaccgcaccgtccatcaccacctgcttactgcacaccagtggccccaggaaggacgacatctcgaaccgtgccccgtgaaacctggcgtcgccggagaaagttgccccctggaacgaggtatcgcgagagaaggtggttccgtcgaaccgggcgtcctcggagaatttcgcatcgacgaatcgcgcgccagcggagaaagttgcttcgctgaaccaagtgcgggagaagcgcgcgccgatgaaccgggcttcgccggagaaagttgctccggcgaacgaggcttggtcggagaaggtcgctacgtcgaatgatgtgcggcaggagaaggtcgttttcccgaaccgagcgccatgcgagaaggtcgcgttctcgaactcggtctcgccggagaaagcagctccgtcgaaccgggcgtcctgggtgaaggttgtttccctgaactgggccttgcgggagaaggttgccccgtcgaaccggacctcgcgggagaaggttgctccattgaaccgagcctcgccggagaaggttgccccgtcgaaccgggcctcgcctgtgcggggcttaccagtggtggggtcacgcagggcggcgaggagctggttcagcagattaggggtgaagggagtgcctcggtggtcgatgtcggcgccgggtgacagaactgtgaggtaggcggcacggtcggtgtcgtccaggtgggctaggcaggcggtatgactgccgacgcggaggccacggcagccgaccggatcctctggagtggcgtcatgggcacagtgtggccacgcaggtggagtgctcgacggcgtagacggcgtagcagacggcatgccctagggacgcgctggcaccatcggacagttgcaggattcggtcgcagcgaagctaacccctgaaaactccgatgcgttactgaagggcgcactgaaaagaatcatgcgctactgaaatcttcggtgcggtccgacaacaacaaacgtgcctaccgaaccgcccgccctgagataaaaggtcttcgggctcatgatgaagaggcaatcgaattgctggcgattccgcaggagccgcagaaggacgtcgcgcagccgtcccagcacatcggtccgccgcccgaggaaggcgaggacgaatcacggttgctgctccgtttcgcagccccgcgtgatccggtgatggtcgcggactgggtgtccttcaacgtgatcgacaccgagaagcaggactgggcccgcggctgggcggcactcaagaagttcaccgaacgtgagcagcacgccagagtcccctatgggtacaaagagggtgcttaccctctcgggcaatgggtcgcagaacagcgacgcgcatacggggcggggcagatgaccggccaacgcgcccggcggctggagcaattgggcatggtctggtcaccggccgatgagcgattccaggagaacctggaagcggcccgcgcgtacttggaggagcactggacgctgtgcgcgccccgctccgcgaccatgctggaccggccggtggggcagtggctgtccaacctccgccgacccggcgccctggaaggacaccccgagtggaagacggcgctggaggccgtggacgaggattggaacccgtcgtggccggcggagtggcagcggcactacgccgcgctgcgcgatctggtggccgacgaagagggccaggccgacgtcctgccgggcttcacggtccacggcatggacatcgggaagtggctggcccggcagcggaagcccgaggtctggcaggccctgacggacgggcagcgcgagcgcctggagcagctcggcatcgtgccgctggccctggagccggaggagcccgcgaagccgtccgcgacgcccgtgggggccttcgagcggggcgtggcggccctggcgcagtacaaggcccgggaaggctctgtgacggtgcccagggcccatgtagagcggctggaggacggcaccgaggttcggcttggggtattcctgaccctcgagctggtgcctctcccagcgccagtgggaccgcctgcgccctgtacctgacggccgtcagtgcctaccactgatccggcgatcatcgcccctgccaattcccggtcccgtagtcacctccccgccgcctcggctgtcgagaacgtttcgacctgcctacgtcgttgcgggccgtttccgagtgattctggtgccgctgtcaggcgaactgttcagcgacagtcgaaagttcagctgcgcttcaaaaggtcaagtgcgcaggcatctgttctgtagcgccgcatggcggaaatcgttcgatcgggcgtgctgtggcgagtggttgcacgaacgctcggacggatgttgccgcgggtgcggccgatcggtggacttcgcggaccgcggcagtgcggcgtgctgtccacaccgccgcgcatcaacgcccacacacgttgtgtcgggcaaccaggacgactcgttttcctcaacgcgatgcatcacaccgtactgcgggtgacgacggtggagccgcgtgacgcatcgcggtcggacgccgaggtgaggcccttgcccgatcccgccgtcaccgccgatgacctcccaaaacaccacagccgcgccctgcgcaccaaattttttgcctatcaggaaagttcaatcacgaactaatcacgttccgtaccttcgcggcaaccatgcaggtccttcaccggtcacccacgcgcaaacacagcagaaacccgtggggagcaccatgagccagcagcagtacccccagccccagcagcccggccgcaacggcctggccaccaccgcactcgtcctcggcatcatcgccgtcgtagtcagcttcatccctgtcctcaacgtcgtcgtctggccgctcgcgatccttggcatcgtcttcggcgccatcggcctctccaaggcgggcaaggtccgcaagggcaagggcgccggcatcaccggcctcgtcacgtcggccgtagcgatcatcatgttctttgccatgaacgccctgttcttctccgccgtggacaaggccagtgaggagctcgacaagtcgtacgactccaccaccgtcggcgacggcaagtccaagaccggcggcgccaaggagtccaaggtcatgaaggacttcaaggtcactaagtgcgacgtggtcaccggcgacttcggcatcaaggagatggccatccacgtcgactacgccaacaacggcgaccgccgatactcgtacttcgtagagggcgaggtcctggccgacggcaagaaggtcgacgacttcatgtcaaccgccgagaacctcgccccgggccagaagttcactgacaagaacgctggtgcgctggtgaacgcggacgagatcaaggacgccaagaagctcgagtgcaagaccatcaacgcgtcccgaactgacttctgatcgctgacgtcgcatgacgccgaccaccatctgcaggcctcgccgcgcaccccgcagcggcggggctcgctgcatcatggagaccatggagtcgcagcggcacgggcgccggccggactgaagcggggcggagacatgagcgcaggcccggccgagggccgggccgcgcgcggggagcggagcgagtctcaatgacggagtcaagccgcttgcgtggcaggcggggatagacacgcagacagaaacagatcaggcaggtgctgaatccagtgcctgcctgatctgctgtttcggctgtcgggtggcgggatttgaacccacgacctcttcgtcggttacgaacgccccaagtagccgcaccgtcgggtgtctgcgcactgaacaaatcagtgcgcagatcctcgattccagctgcgcagagaagagttcagtgcccaggtcaaagccttgggcgctgaactgtttcctctcgtccgacacctgagcggccgccacctcgcgcggcagctcgccggagcggcggacctggaggcggtgggcccgcgatgatccgcccgcgcttagccccgtgtccggcgcaccgacggggccgtgacaggcgcgaccatcatcacggtggcgcccggcccggggatgccgctacgtgccgtgccgtacgggcgtacccgcgaggcggtgctgacggtcacggcgacttccggcctgctggtagctgaacgaaccagtgggcgaggtgtcgacgctgccgcgctcgccgctctggctgcggaccccgtgaggcggaccggtgagggggaatgccgcaccagatgctgcgacttgatgcccgagccgaccgctgccggggaagcggcgttgaagcagccttcatgccctgttgggctgtgccaccagcggttcatccccgtgccgctgccaccgcccgcacggcgtgcgccctgacgagcccgccgtgcgggcggccccgcgagacaactcgacttcccttgcagaggcaggcaggcgatggcccacgcgcaggtccgtgacgtcccccacaccacaaaggcgccggcccgcgcaccacagccgttccccctgcccgcaccggccgacgacccggagctaccgcgcaccccgccgaccttccgggacgtgctgcgccaccgatattgcggccgcctgctgatcgcctcggtgaccggacgcttgtcactgggcatggcgcccgtcgccctgatcctggcggcgcaggcggacggccactccctggcgagcgccagcctgctggccggtccgggtcatgctgcccgccgatcccctgctcggcaccgatcagcaggaagtcgtggcgcggctgtggaagcggcagcaaaccgagacgggatgggcctacctcgtggggctgccgtcctaccgagatcgcgaggacggcgatgtggaggcggcggcgtaccgggtatgggtgcgcgctcccgaccacgtccggccggtcgacggcgtcgactacgaccaggtcgtcaccgagaagctggaacggtcaccgcagtcggcggtccgtgaggtcctcggggagcgccggccttcggggtgggtgcttgcgaagctgcgcgacggccgcggcccggcccgctccgtcctgcacgcaccggactgcgaggaagcaccggcgggggcgccgctgctcgatatggaccgcgcactggactcggcagaacacccgggcacccggctgtgcacgctgtgcggagccgcgcaggagctgacacctctgctgcgcggcttcgaccacatcaccgactccgcccccgacgactcctgaccctggccgccgcaccgtcggcggccctggcgcggcggccccgcccggcgcgcaacaccagcgaacgcgccccgatcccctcgcccgcagcccgggacctgacccaccacccaccttccttgttcttcctgctgtggggcgtggtccgggggcgtagaggggatgtcagaggcccgaccacgcccgtacggtgggggtgacctgcacggatgcggcggcgcccgtgaggctcgcgcaagagaagtcgcaagagatgccgcaggagaagacgcaagagttggcgcaggagattttgccgcgcgacagaccggagcgcggttcgaacagcagtacctttgcctggcggcttcgtacgacttcccccaggacctgaccgacgctcaggacgaactccgtcaggtccgcgctgatctgcagacggtctaccggcgggtgccgtggtcggccgaaccgctggacgcgtgggagacgcacgagaacgcctggcggccctcatcccgccctgcctcccccggctggggccctcaggacgcggcggagatcgcccggctacgggcgcgggaagtcgaactcgccacggcgaacgtcacgcacgcgtactggagcgagttcgctccggcccacgtcctcgcggcccgtaacgcgctcaagcgccaccaggagcagcagatggccgacgcctccagctagccgccgaccacttccccggccgccgcaccgtcggcgggccttggcgcgcccgccccgcccggcgcgcaacccggcgagggcgccccgatccccggctgcgtccgcgccgcccatcccgccctcccacccctcaactccagccagggcatgggcgaagggggtcgcaacggggatgtcagcggcccgaccacgccatacgtctgcggtgacctgggcggacccgaggacgcggtgaaggcctgcgcaacctctaccgcaacacctagcgcaatccggggccctacgcggtcgggtgaagacgccaggatcggagaacttctgcgggtcgcggcgcgtagtgccaaggcatgagggagatcactgacgcgcacgtggcagagccggacctggctgtggtggaggtcgcggccgccgatgatgaaaccgcgctcgcggtccaagagctgctcgccgcgcggtgcgcgattgcaccggcggaccgtacgacccgggagcctggtgagcccggtgtacggctgcgctgctccctggacctgcgccaagaacccgactcgtaggactgcggacgagcgaccgcgtccgctgaccagccgtggtccgggtcatggtcggggctggcggcggcctggtcaatcccgtggtcggtctgctaccggtgggagtggtcgtccacagtggggcgatgagtgaactccgcccctaggacgaggtgtcctcaggcgctgcgtgatcggcgtgctgccgtcctcttcgtggccttcttcgccgtcgtcttcttggccgactgctgcttcgcggtcttcttcttcggcagctcgtggacgccggcgtccacgccgcgggaggcctaggtcgtgtccgatgggtcgagtgacgctcccgttgggaactcgttccgtgggacatggggcggggagatctttcggatgaggagtgggctcgcctggagccgcacttgccggcgaatcgcgggcggggaggacgctggaaatgccaccgccgggtgatcaacgggattctgttccggcagcggaccggcctcccctggcgggatctgcctccctgcttcggtagctggaagacggtccacgaccgtcatcgacgctggtcggcggacggaacgtgggagagaatcctgcgggccgtccaggccgacgccgatgccgagggccggatcgactggagcatggtcagtgtcaattccacgacctgccgcgctcatcagcacgcggctggcgcctccacccgcgccccgaagatcccgggtcgacgcaggagccccgcgcgccaccgtcccgatgaggccctgggacgctcgcgaggcgggctcacaagcaagatccacctcgccggggaaggcgggcgccgcccgctcgggttcctcatcacgcccggccagtggggggatgcaccgcagatgattcccgtcctggaagagatccgcgtgccccggcaggctggtggacgaccgcgcactcggcccgaccatgttggaggcgataaggcgtactcgtcacgccgcaaccggcgtcacctgcgcagacgtcagatcaagcacacgatccccgagccaagagaccagcgggccaaccgtcggcgccgcggcagcggaggcggtcggcccacagggttcgacaaggcgatctaccgccgccgcaacgaagtcgagcggaccatcaaccggctcaagaacttccgagccatcgccacgcgtttcgacaaacgggcgtacgtcttccacggaacggtcaccgtggcggcgatccgcctatggctgcgtccggagtgaagtgccccgttcagagatcctcggcacccgggtagtgctggcgaagttcgctgagtacgcgcttgtcgacagccctgacatcccacgaggagctgtcgaactcggtcaggacgagcaccagctcgtccccggcgaacccacgtgcttcggcgtcgatcaactggaggaagggggtcgtcaacgacaacagcgtcaacgtgtccatgccggcgtcggcggaccgtctctccatctcgacacagcgaggatcgacgatctcgtcgaactcaatgcgccacgtcaggtccaggccgaagctgccgagccgaaccagcacctcagccagggtcacgtagtgctctccgtgccaggcaggaaacgtgattcccctcatccccacctctgctacggctgtatcgcgtgacatgcggcccccttcgttcaacgaacattaggccacggctctgatcagctcatacgacccatcggacaggccctagccgtcgccacgggcctggttctcgaaccggttgagcccaggggtgtcgaaggccctgggctggtggacggtgcgggccagatcgagcagagagtgaatgtgccgggtccggccccatcctgcagaaatcaccggccgtcagcacctttgagggcgttcacggcgtcatctctggacagctcaagcagtgattcctcggagtaatcctgaatgtcgctgacgtagggcgggatgcctgagcggcgtgtacagaaggtgacattagccgtgagggtgtcgtccgacaggccgccctccgagagggaaacgtaccccaggagtgggtgctcgctttccgcaggggcagcctgcaaggccaggcaggcgtaagcgatggagcgtcgcaaaagccgattctgcctttcgggccctgaagcggggaggtcgtagtccatcatgccgcgcccgttcaccgtggcttcgaagtgaacaatatcctcgaattctccagcggtggatccgtggtaccccgcctgcaacgcggagagcaggtaggcgccattcccgtccacggtccagccttcctccgcgatcgcacgatacgcggcaggaacgtcgtccggaagaaccgatggcagctcggcaccggcaaggctgagcattatctcgttcattctcatcgctaatcctctcccagaaccctgagccccttgcggatacccgcttcgaaaccaggaatcttgccgacttcccgttcaaccgaacgcggcaatccgtcgaacttcccttcgtcgaaattgtactgatacttcgcggtggggttgctctggtcctggaaatgcagctgcccggcccgctgccctggattcggattctcaacgtcgatccggtacggcccgtgattccacatggtcttgcttgtcacctgggtcccattggctccgatcatgccgctcggcggacgttccttgatcccgtacaactcgcgcatctcgttgatcccccgctccaccgcgtcggggtggtagggatcgttcttgaaagcgggctgggaggtgtatccctccggcggctcgcacttcagcccgagcgggtcggcccacatatggggattgggcacgtaggcggccgggttgggcgcggggccgagtccgagggggtcgggggtgacgtagcgggcggtctcggggtcgtagtgacggaagtagttgtagtgcaggccggtttcggggtcgtagtactggccggggaaacgcagcggcgtgtatgccgtgctgttcttcgcccaggtggtgctgccccacagggtggcacgggtgcgccagacaatctctccccgctcgtcgaggagttcgctcggggtaccgacgaggtcggtgacgatggcgaagaagcgggagtcgatctcctgctggggtgcgtcggccgcgacgatacgttcggtctgcgtgaccggccgtaggccctggtggtcccaggtgagggtgacctggtggggcaggtcgggagatgtggtggtctgctcgcacagaaccgtgccgtcccaggtgaagtcgactcgctcgacgagggtttcgccgtcttcggcgaggcggagtttggcggtgcgccggcccagcgggtcgtaggtgtagcgccagcgggtgccgtccggggtggtcacggaggtcaggcggtcttcggcgtcccaggtgtagcgccaggtgtcgggtttgcgggacagtcgggtcttctggcgcaggatgatgcggccgaggccgtcgtgttcgtagcggacctggccagcgcgcgtgagactggtacccgtgtatgtgcgattgccgatcgcttcctggccgggatgacccgccggccaggaggccgacgtctggttgcccaccgcgtcgtaggcgtaggtctcggtccagttcaccgcatggacggccgtcacccggccggccaggtccagatcgaagcggcgcttgcccgagagttggtcctcgatgccgatcaggtggccgtcggcgcggtaggtgtactggcggtgctgcgtcctgcgaccggccggacccagcacggactgggatgtcaggcggccgagggcgtcgaaggagtgttccagggtgatgtggccgaagcggcggccaagctcgcggcctgcctcgtcgtagacgaagtcgatgctccgaccggagccggtcatgctggtgcggcgcccggccacgtcgtaggaccagatggtcgtggcgctgctgggggtggtgcggcgggtacggcgaccgagctcgtcgtagtcgtaggtcagtgcccggccgttgaccgcttccgaaatcatacggccgtggcggtcgcgcaggatggtgagcgcggtgccgtccggaccggtggcctgcgccagctggtcggtgaagtcgtaggcgtacgtcgtggcctgtccggcggcgtccttgcgcacgatctggcccagttcgttgcgctcgaaggcgatcatctggccgagggcgttggtgcgcgaggcgaggcggcctgcgaagtcgtactcgtaggtgagggttcggttgtcgaagtccgtctccgcgaccagccgcccggccgcgtcataggcgtagttccaggtaaggccgtgggggttggtgacctgggacaggcgtagctcggtgtcgtgctcgaactcgtagcgcaccccgtccgggccggtgcgggcggtgggcaggtcgaagtgcgtgtactcgaacagactcacgcccccgaccgggtcggtgtggctggtgcagttgccctcaccgtcgtatgtccacgactcactcgtgccgtcgggagctgtgcgccgagacaggtggccctccactgtccactccagccgtgtggtggcgccggttggatcagtgatcgcagtggtgcggccgaaggcgtcgcgctcgtatcgcgtcaccgcgcccagggggtcggtgactgtcaacggcagtccggcccggtcgcagacgatgccggtggtgtgaccgagcggatcagtcatcgacgtgagacgaccaccctcgtcgtagccgaagcgggtggtctgaccggacgggtcggtgaccgaggtgaggttgccgcgttcgtcgaaggtctgccgggtgatcgtgccatccggattgaccagtttcaccggcaggccgagggcgttgtactcggcccgtgcctcgcggccgtccgggcgggtcgctgcaacgaggttgcctgcgtcgtcgtagcggaacgaggtcgtatgcccgagggggtcggtctgggacagcagccggttgtagcggtcgcgctggtagcgggtgaccgcgccgagtgcgtccgtctcagcgatcacctgacagcgtcggttgatcaggtagtgggtggtttgaccgtatgagtccgtgacggtcgtcgtgtgtgcgccggtgccggggtcaactgccccgtaggcgaaggttgagcgcaggtggcccgcggcgcccgactggtgggtgcagcggtcttcgtcgtcgtaggcgtagctgaagtggctgtcgttggtgtcggtccaggaggtgatgcggccgagttcgtcgcacacgtactgaagggggcggccggaggagttgacgacctcggtgaggtggccgtcggtgtagccgtagcgaatcagatcctggtccccgccgtccacggccgcgctggccaggtgcagcgcggtgacacgcccggcctccgtggatatgcgcaggcggtagccgccgctgtgggtgagataccggggtgcgccgtcggcgtcgtactcgaacgtgatccagttgccgttgcggtcgtcgagctgctccagcaccgccagagtgtcggagcggtcgacgaagtgccgtatgtggcccgacttctggtctgtcagcgtgtagccgccgtccgtgcggtcgagtgaccagcgcggaccgtggctgggcagggtgggcacgccgggggccgggtgtgggtaggcgagcaccaggccgtcctcgccgacgaggacaacacccgccgtgtcgacctccaggcgctggtcgagcgttgaggaccacgtcgggccgaaccagccgcccagccggtacgacgactcgaactggcgcttgacgaccagaggcagctgccccggaagcgagacgtcgatctgtggcagtaccatccggccggtcgcgacatcgacggggtccttctcgcagatctttgcgccccgctgccgcgacgcgtcctcggccgcgtcctccaccgcgttccgcgcggtcttgcgcagcccctgctccgcaaccccctccatgccctccttcagcgcgagccgcatcccgccgcgggccagtcccgcgcccttggtgccgatgagttccgggatgaggcggccgacgaactccgaggggtccttcttgaagccgtccacggcggcctggacgacccgttcggggtgtgcggcggtggagaccaggccggagagcgtcatgctgacgttctgcaggtagacggccgggtgggtgaggttgtaggggtcggtggggttcaggccgggggcgaagtcaccaggccggccgtgcccttgagggcgccgcccaccacgtgggtgagttcggtgttggccgcctggaagccgtctttgaggtcgttgccgatgcggtccaggggcgggggctccgcgggcgcgtgcgccagggcggccttgattttgccctgtgcttcggaggcggcggtgttgcgctgcttgcgggcctcggcgagtttctgggcggcggccttgatgtcggccttgccggggtcgtggaacggctcgggtttcgggcccgggtcctcgttcgccttgatcttggcgttgtaggcgtcgaccttcttgttgtaggcgtcgaccgcgtcctgggacgccttgacacccttcttgtagagctcgacggcctccttcgcctgcccttgcgcccacttgagggtgtccgcgtacaactccagcgcccccgccgccgtgttgcacgcctcggccgcctgtgcccacttggtggggtggacgccgaacttctcccggaaggcctcaccgccctcaccctgccagccggaggagtcgaccttccgcagccccgaactcaccttgtcgaaggcgccgtggaagtccttcaggtgcttggcactctcgcggatcttgtccggatggccgtagacgagttcgtcgggctcctcggtctggccgagctgctgctcacccggggtggccccaggtcggaggcgatttcgtcgccccagtcctccacactgtcggcccagtcgtgcgcaccgaccttgtccaggccctcgcccaccttgtccgtggcccagtcgacgccctcgccgagcttcttcttgcccgcgtcgtagaggttctccgcgccacccagaagcgagttggtgacatcgccgagtcccatcagccctcaccgccctgctgctcggccgccttggcgcgagcctcgggagagggcccgaaggtgtcgtccaggtactggttgtactcgtcgtcggacactccgaacgcgccgtgcagttcctccgggttcacgcccggcaccggaccgatcgtgtgcgaggtcatcacgtcccggcccgcgtccttccaggcctgcccgctgttggccatcgcctgatcgaaggactccttgctgtagtccacgttgccgccgtacaccccggacgtggcgatgtcgccccagcccatcttctcaacgttctcctctgaggcgtacggattgccgatggccgcgttggtgacgaccttgaaggtgccctcgatgtacttgtcggtttcgtagtatgtgcccgccgacaggcccgtcttcagcgcgaagccgttgccctcgttgatcagcgaccgcacgccccactcccagcgctcgcagaacgacgtgaactcacccgtaaggccctcgtggccgagctcaagcccggacagggcgatgtcgccgaagccgcgcccggctccggcctcgccgaccatgcccagctccttcaactcgcccagcgcctcggtcagacccttggcgatcagcgccagcccctcggtcttcaggtccttgccgtcaccgctcatgccccgcccccgcgtccctgtcggcgtcgatgtcgagtgctgcctcgtccggcacgatgccgcgcaccggcgggaagaccatgccctcttcgccgtccgcgcagtccagcgccaccccccagggcacccctgccgcgggcaccgccacatccagcagtcgcgcgccgaggatcgtctggtacgtccactcacgcgccgcctcaccgcgtgccaccgcgtaacgggccaacgcctgctcgtccgagaaggccaggatgaaacggatgccacccaagtccgcagtcaacaagccgcgttcctcgtccggtccgggaccgtcgccaagcgggaccaggacgggggtacggcggaagtcgccgagcagcgccgcgaactcccgcctgcgtgccactatttcgggtacctcgcgtgcagcttcgcgcagaggctcccgagagggcggatgttctccctgctgtgaatccggctcccgctgctcacgcgacgacgtcaccggctcaggagcggccgacgcgtcagtcatatccgcgtagtccgcaagtcgcgaccgtggaaccctctgcggcccgtcgaccgcacccccgtgctcagacatacagcacatcatcacaactgcacacggcacgccgcaaacgccagccggagcaaccgtcgctttcatgtcaccgtgcaagcaagtgacggacggtcatgcggacgaacgacatcacgctgagccagccaaccgttccgtgcgacatcgtcctgccggcacctccaggatcggctgcgtcatgccgtacgtcccggtgatggtgtacgcaaagagcgggggctaccgggaactcgccagcacatcgagtacgcgcagaacaccaagcacctgccgagcaagtacgacaccaggaaggtcgctgaccgcaccccgcacgatggcacccctcgccccgatctctcccctgccgtcgtcccccaccacaggtacgggacgacgggctgagaacggtgacggccagaggccgtagccggcccgtgcagctgcttcaggtgttcgcttcgccgtctggacctgtagcacgaaaggaagcccaggcatccaattgccccgaatagcctgctcgacggttccgagccgccggagttcctgctcagctccatcgcgggtcacggttcgcggcggctgggcctggacgccatccaggctcggacagtgtcggagtaccagtacggcttgccgccttccacgtggtccggcgccggcaaaagcccgtgcttgcgataccagcgcaccttatcgggccgcacgttgatgtacgcggcgatctccttgtacgaccacagcgcccggtcgatcgtcttcgtcggctcctccgcagtaccggagccagggatgagcgtcatcgtgcgcgcgtggtcctgttgtgttgcgatggcgtcgacgagctcggcatgggtggtggcgaggatctggtccaggcggtcgtcggcctcggtccgctcgtgcttgtcgagcgggaactcacgcattgttgtctcccttcatgaggccgagcgtggtcttcaggcgcgcacgtgcacggcagatgttcgtgttgacggcgccgggggccatgttgagcgcttcggcgatctccgcggtgtcggagtcgctcatcacgaatgccatcacggtgcgctgggtcggggggagctgctggatcgcatcaatgattgcgttcgtctgctcggacagctccacgcaagtcaccgggtcgatcccgcccggcaggtcggggagttcgtccgtcgggatctcgcgggtgcgctcgttttgccgtaaataggcgcggattgcggacttgcgcatgtaggcgcgaggatactccagggtcttccaccggtcggggagcagctgggacagtacttcgtgtgcgaggtcgtcggcctcccacacacgtgccccggcgtagatcaggaaggcgatcagacgcttcttctcggtgcgatagaagacggagaagtcgtcgcgcctcaccaactcggtcgacgggactggccgggtttcagggagcggctccctccgtccggcttgggccggggtttcgctcatcacgccgccttactgggcgggagcttgatcgtgacccgccggccgtcgcgcagaacctcagtgacctcgctgccgggcggcagcgagctgatggtctccatcagagtcgcacgttccaactcagcgcgatggatctccaactcgacgcggcgcctgtgcgaccacgcgctcagccagacgtatccgagccggaccgccgaagtcgccacgccacagcccgcggtgaacgtcaccgggtccatggtgcctcccatttctgtctcggcggcgcatcccgagccccgcatcacctccttaagtcacgaaccccctcctgcattacatgccaatgtggatgtttcggcaccgcgtcaaaaggcgcagagcatggccggtcccttcctctctacgcagacgccacccgatgaggtgatcgcgaacctcgccgaaatgtcagccgaggcaaccccgcacccgctatagcagtcggcatgagaatggcctggcctttcgtcacccatgtcagcaacaggtgagcaccatccgccagtgccaactaccaggtcactgaggctgcgccactgacattcagatgacgatgcccagctgacacttccccgcagactgtcaccaacatcgtgcaagctctccgcgagcaccaccccaccaccggccagaccccgccctcaaactccggcactaccacatgaccaccccccagcccgaggcccgcacgccgcttcttacgtagcggcccaatcaacctgcacgccacccaggcaacctgcacgacccccaggccagaagcccgcagcccccaccaccagaccaccaaccggccccgagcaacacgaaacgaaccgctacaactgagaaaccaccagcccagaacacccgcactacgcagaaagaggacccgcgacataaagagggcgcatacccccttggggcatgggtggcagaacagcgacgggcctacggggcagggcagatgagcggcctgcgcgcccgccggctggagaagctcggcatggtgtggagcgtcgctgacgaacgcttccaggagaacctggaggccgcgaaggcgtactacgaggatcactggaccctctgtgctccgaggtcggcaacggccctggacaggccggtggggcagtggttgagcaacctgcggcgcgcgggtgcgctggacggccacccggagtggaaggccgcgctggaggccgtagacccgtactggaacccggactggccggtggactggcagcggcactacgccgcgctgcgggagctggtgcgcgatgagggccaggccgacgtcctgcccggcgtgaccgtgcacgggatgggcgtcggacggtttgtcgcgaagaaccgtcagcacgccgtctggcagggcctgatggacgggcagcgcgagctcctggaggccatcggcatcgagaagggcaacctgacggccctgccggaactggcccgggagtacgccgaggacaacaccggcgcccgtatcgtgatcgtcgaccgcaccggccgactgctcaccgactccgcaggcaccaccgccaccgggaccacgctcgccggcgagccggacatcgccgccgccctgcgcaaccagaccacggtcgccacccgcaccggcactgatggtggtgacgttctggcggcaaccatgccgggctcctccggcaccacgatccgcggcgggctgcgggtgacctacccgatgaccatggtcaccgaccgggaacaccgcatctgggccgccctcgccctggccggcgcgtgcgtcctggccgccgtggcgctcgtggcgttcaccctggcccgctggatcacgcgccccctgcgcaccctggaacgcgccaccacccaactcgccgccggccgtctggacaacccgcccgacgccggcagcggaccgcccgaactgcgccgcctggccgccgcgttcacccacaccgccacccgcctgcagcacctgctccaggcccagcacagcttcgcctccgaagcctcccaccagctcaaaaccccgctgacctcgctgcggctgcgcctggagaacttcgagccctacctcgacccccgcgcccatcccagcctggaagagaccatcgcagaggtcgaacgcctcagccgcatggtccacggcctgctcgccctggcccgcctggaaaacaccgccaccacccccgaacccgtcgacgcggacgccgtcctcgccgagcgggcggccatgtgggagccactcgccgccgagcaatacgtcaccatcacggtcttcggcccagcggtcggccgggtgtgggcgattcccggcgcgctggaacagatcatcgacaacctcgtcgccaacgcgctgcgggtctctccgcccggcacgtccatcaccctggcccgcgctcccggcgccgatctccacgtcatcgaccagggccccggcatgtcggaggccgaccgggaacgggccttcgaccgcttctggcgcgcctccgactcccatcacgacggcaccggcctgggcctgcccatcgtccgccacctcgtgcacgcctccgggggcgagatcacactgcatgcagccaccggcggaggtctggacgcccgcgtccggctacgccccgccagccgggaacgccgctttcaggcaactgccataacaggcgcggcaggccgcggacgatgagcacgaatcgagagtgctgtgcgggtggaatgtccttccccctggaggcctcaagccgatgaaaccgcgtccgctgtcctcactgacgactccttcaacacgctgacttgccaaggaagacgaacctgtccgggtgcggccggtcgtcgttcgggctccgatgccggcgacgtacagcccgcggtaggcgatgaacccgttgtcggccgcgtcctcgccgctgggggtccagaggcattcggcgagacgggcgtttccgtcgtcggtctcgctggtctcgatctcgtacagggccgtcgtcatgccgacacctcgcgggcgatagcggccgccaggagcacggcggcatcggtctcgtacgggtcgtcgtagctctcgtggtcgctgacgtcgaacggcgcggccttcgcggtgaccgtgaacccggggccgacggtggccgcgctgcccgccagctcggtgttgaggcgatcggcgtcgcgggaagcgagccagtctggttgtagggaccgaggcggagcagcgtgtacccggtgttgtccggtcgccgggcttcaacatgcacgccgtagttcgccggggccatgccgacgacggccggaaggtccaggcccgccgcggcgtgggtgagcggcgcgtaggccggattccacgcgccgtggatcgagtccgtctcgcagcgcagccagcccagttcccggtagcgctcgccgtagggcgtgtacgagccgccggggtgttgcagggcgacggcgatgatgtcgggtccgtggtcgtcactcgggcgcgggtgagcgcgctcaacgaacggcccacgcggacggcgaggtcctggcagtggccgggggtccagggctccggtcgcgcagggcggcgagcatcgcacggaactgatcgacgcggcctggtcctcgggggagagggcgccgggcgcctggccgcatcggcggcagagacggcgcttcatcgggtggcctcctgtgtggggctggggtgggcggttccgctggcgggcgtcttgagcacgcgcggcaagtggacgtgaaggtgctcgacttcgacctcgcggccccggtcgcggagtgcgcgggcaaggatttcggtgaggccgcttcacttaaccggattaagaccctccgagccgaatcatcgacggggcatggcagacggccgcaggcggcgatctgcgcttcccggaggcactggggaagcgaccactcgggtcgggcctcatcgaacgctgcctcgccggcttcgcccggccggtccgggcgaacagagtctggcccatggaagattcaacggaggcgagtcgggtctggcggacacggtgggaatgacattccgctcggcccggaccaggtcgcggtgagcatccgccatcgccgcgcgggggcgtcgaggagaccgccttcgcgcccgccagccgggagagggtggcgctcaccgcgggcgtggaggcgctgccagtgatcacccaagaccggcagatatacttcgtagctcgatatatgattgatgcatgaccagacggaacccgccgttgacggaaccgcagtacttcatccttgctgcgctcatggatggtccgttgcacggttacggcatcatcaaggctgccgagcaggccaccgacggacggctccggatcgctgtcggcacgctctacggggcgctggagcggatggagcgggccgggctggtggccgccggccatgaggagatcgtggacgggcgagcgcggcgctactaccggctcaccgaggacggcaccgaggcgctcggccgggaagcgctgcggatgcagcaggcggcggccgtcgtcatcggacgcgcgcgggatgccggagcggccccggcatgaatcgtctgctgcttgcggcctatcccaaatcctaccgttcccggcagggcaaggagttgctggcctgccttgccgaggcgtatcccggccgctcctggccgccgccgcgggaagttgccgccttggtgcgcgccggggtgcaggcccgcgcccgtgccaccgttgacgacactactcggccgtggtggctggacggcatccatctggccgccctggccctcgccgcgctggcgctggttccgtacttgcaggatgtgtggcactgggcactgcacatcgaccccggacagcacgccatcgccttccacttctccggctggtatccgtgggccggaggtcccacgcggattcggctgctgccctacgggctgctcccgctgggcggcctgatcgctctgctgcgtggcagagcgtggatcgcgctgccggccgcggcatccatgatctgggccggcgccacgacccacggccgcaccctcttcggcgacgagggcaaggcgggcttgagctactacgggttgggcgccccgataacggcccgtgacctggcgctctcggggacactgtgcgccgcgtgcgccgtgctggcgctctgccgacccagccgtctgcgacgccgctcgtaccgttggctagcccccgtcgtgctcgccatgttcgtggccgggggcctgcacatcatctctgtcagtccgactttccagcgcggcttgttcgtcctcgaggtcgccgcgctgctcggcgcgtgggtggcgacggcagccaccggcgaccaccggtggctgatccccgtcgcagcggtcgcgatcgtccgcacgcaggcgatcgtcgcccagccggacgcgttcatgcagtcctttccggacctggtcgttctcctcctgctgatcgcacccctccctgccctggcgatcaccgcccagcgccgacagggccaggcactccccgaataggagcggacccccggtgggccggccgagcccggcggcccacgtcgtgccacaagacgtgcgtgacctaactcccctcaacggaagaaacagagcgatgactcagcacgatcctccgaccctgcccgcgcaccgtccgcgggcctcaagacaggcccccgaggcccccgacgcacccagcctgtcgcgtacgacacggccgtggatgccggctctgctgtacaccctggggttcctgacggtctacctgctcgccatctgcaccccgtgggggcaacgagctgagaacgccctgtttggtctcggtaaacaaggcggcgaagaagcatggttctaccccctgtcaggagcggcctacggctcgacgcccctgccgccgctggaattgagtgccaagcccaccctgatggtgggcctggccgtcatcgtggtcctcaccctggtgcggcggtgctggtggccggggtgcgcggcgctcggggtcgtcattctcacgaccggaggcaaggaggtgctcaaatcgaccctgccccgccccgatctggtgggcgcgcccgagaatctccttgatcaggggttccccagcgggcacacggccatccccgccgcgctgaccctcgccgccgtcctcgtggtttccccccgcatccgcccctacgtcgccacggccggtgtgctgtggctcgcctgcatcgccgcctacagcgcgaccaacggcggccaccggcccagcgaagtgctgggggccacactattggcctgtgcctgttacggcctcgcaacctggctgctgccgccgtccgccgcgccgggcgccacgcggagccctcgagcgctgcccgtcatcaccctgacgctggcactggccgtcgccctcgtttccggcgcacgcaacgacaccctcacaaggtcactggtctccgcggcgacgggcttcatatgtgcggccctggtctggtacgccgcagtcgggcggcctgcacacaccgcacgccgcacacgccccgcactgggctgaccacccggccggctccgggcgggaaccggcgcatcctggcaaagcggctgtccgatgccaccgcccagtcgtagaagccgtcgacgcccgagcggggatgcgctcccgcccgacgtgtcctcccatagtccggtcaacaggtcggtgccggcctcctgttctctcgcctattccgacttgttgccgaacatcaatcgatcacgggtcgtctgtagctccccacgccaagccggttagggacgtgcgacgtgcactgcatctgtccaatgagcactggacttgtcgcgctgggtattcgagttggcgggcgggttggccctcgtcgaggctgagcgggtggggtcacagatggcgtgagcgctggaccgaaagggtttggcacgggggccacacatcgacgatgatcacctcatgaccaccagaaagggccatgccttctaggcggcccgcttcgctctccaccgctcgcgcaccgccgccgctcaccgcagcgcccgaacgccgtgaccgcccacccaggagagcccgcccgtgcagaagactgccctcgttccctatgcccaccttccccgagcgcaccacgcccaccacgtcctgaccagcaccgtcgacgtcttcggcaccgcccactggctgcttgccgaccgcgctccgcagcccggcggcgatgtcctgcccttcgacgcgctggtcgtctccgtacatccgggcggcgacgtcgaactcaccgagctgagcgccgtgcgggcccgctggccgcacctggaccgcctgcctgacggcgggttcgtcgtcgcagcatcccgcgcccgccggtacgaggacgcggaccaggtccaggtcttcgacgcgctcggccgcgaggcctcctccttctccgtcggggacgccatcgagcacctgctcgtggacgaggccggccacatctgggtcgggcacttcgacgaaaacccggccggaatccgccgctggagccccacaggccacatctactggacgtccgacggcgcaagcatccctggcctcttcgactgctacgccctgaacgtgtcgggcaccaccgcctgggcgtgcacgtacaccgacttcccgctcgtcgagatacgccccgaccggcccgtgagggtgtggccgaaccaggtacggggcgccaaggcagtggccatccacggcgagcgggtcgccttctacggcggctacggcgaatggccccgcccatcgtctggggcccgcgctcctgcgcgcccgcgtcgctgctcaagcagccccggcctgagggggcttgcgtcctcccatccgggggctagcgtccagccagtcctggtgctcacgctcgggcacgtcacagaccatgaggaaggccagcatctgatccttgttgagcattgctgcggggaaggcgccccagaccggcccggcgttccatctcccgcagcggcatcgctccggctcgctggtacatctcgcgcagcgcggcacgcagttccgccgcgttctccaccagtcggaagggggctctcatggctgagcttgtccggcagcagcatcttgacgctgacgtgggctaccacggctttggttttcaggagtccgatgacggagacatcctggcccccttcccggatgacttcgccgacgaggtgttcctgaacgccttcccgggacggctcgatatctacagcgccggccacacgcacaccgcgtcggtcaccgtcgcggtatgggacggcccgccagccgcgcacgaccgggtgcagtgggacgagcaggcggaagccgactacgactcggccagcggcgaagtcgccgtgtggtcgatgagtctggggcgtgctgacgaggtgatcacgctggccgactcgggcgggctctggcgtgtgcgggtgagctgcaccgggcgtgccgtggccgcgcgtctgtcggaggaggagggcactggccacggggtcgagaagtatctggtgcagttctggccccgcacagcctgaccggcgggagccggggcggccgcatactgccgccgccccggcttcacacgggtcaggagacgatcttcacgccgaatccgtcctcgaggccgtcaatgaggcggttcttcgcgtagaagctgagcagcaggctgccgcctgccccgttgtccgccttcgcgatcggacgcacggagaagttgaactttctcgcgtcagggtcgtagtcgtactcggcggcaccttcgtaggtggtggcgaaggggtactcgtcgcactgcgagccggagggaaggaccgtcctcagtccgccgagggcagccttcagcccgacccggaggggattcgctgacggctcatttctttctttcgtcacttaaaccgtgacttcggccatggttctcacaccggcggcctgatgggattcgtacatctgttcccacagagaggtcgcaggttgatatccctcaccgcaagaaccacaggaagacgtcgcttagccctcggcacgatcctcgcgatcgtcatcggatccggtgccaccggcaccgcctactcggccgacggctccgacaacccgccgcccgtccacggccccggggcacgggcagctgcggccgccgagccggacactcccaacggccccgaagtcggcccgccgttcacgaagaccaacaacgtgtggcagaccgacaccaccacaccgacgttacgcaacacggtcactgcccccagcggccacaagaccaccgcgaccttcgaagttcacaccaccgattccagcggcaaacccacggccacggtcgtcaagctgaccgacgagaaccagtggggcgtcctcgtctccggcgaggtgaccgccggcaaaccggcctccgtcacggttccggccggcaagctcaagaacggtgtcacctacgcggtccgctcttccgggtacgacgccaccagcaacgtgtacgagagcgactggtccccgtactccaccttcaagatcaacgtccccccggccgagaagccgtacgtcaccttcccggcaccacaggccacgtccggcatcgactcacttgcgcagactccgatcgaattcacgcgtaccgatcccggcccggtcacgggactgcgcggcgatgacaacggccggaaatgctccgccccggacgccgaggggcggaaggtgtgcatcgaaatcagtcgtgacgcgccgactcccgaagacgcggcggtcgccaagggagcgatgaggcaagctcttcggggcgccgatctcgtctcgtggtgcgccgcgaaaccggacggcaaggactacatgaaccggggcgaggcgtgtctgaagaaggtcggctacgcgaccctgatcttcgtcgacgccgatgacctgccgaggttcggcaccgccacgttcgcgctgtcccagcagatcaagctgtacaacaagaagtcggacaccggcacggaccgtgcggagttcgaccagcagctcaccgtggtcccgacgcagatcgacgacgcgaccgagggcgttcacctcacctggcagccgggcgacaactgcaaggactgcaccagctcgcaagtccagtggtcgagcaacgacggcctcaacaccacgccgcactgggcggtcggcgaggtcggcgcccagtacgccatgaccgcgaagaggcagacgatctggaacggcaccggcaaggagcagttcgacctcggctggagcctcctcggttccgtcgacgctggcaacgctcacgcgcagaccagcctcggcaccagcggcgacgtccgtgtccgggaactggcgccacgctgtgacgacatcgccggaggcaacatcaagaccggctgtgtcttcccgtacttcaagcccacctggacggtcgacaccaacctgtacccggcggccggcgcctactactggctgctgcaggagaaactcccctcccaccccggcagccggaagtgggattccctcgtcacctacctcggccccggcaacaacgccgatccggacggcggggactggaccaacgacgacagccgcggcatcgtctgccccacagggaccagcggtttcaagcccaaccctgccacgcccgacggatcgtgcgacgagtacgcgcccgcaagtacgtaccagagcggcggcatgccgaaggggccgaaccaggtcgcctccgggaaagaatgcgcacagctctacaccaaacccatgaccggcggcacgtggggactgcttgcagaaaaccgcgacggctacaccggcccgaagtggaacgaaaagtgtggtcgtgcctccgttcccacggatcagaacactggcgccttccgcgacctcggcatcaagttcgttccccagatgcggctgctcgacaaggacgggttcttcatcagtgatcctggcttcgagcactgcaagaacgccgacacggtctgcgcgtggaagaaggtcggctgacctgacccttgaatgaccaagcctgtggccggagcaccctgtggtattccggccacagtgctatgcgaagcgtgtccattccgggtcccgcggatgcgccggaccgtcccacaccagggcctgatcgacgagaccgggcaccttcgtgtcctggtgtccgtccgcgtactccacgccgcggttctcgtacagggcatcggcgacttcgatgaggtagtcggcaaacgacgaccacacgcccaacttggggatgccggcctcttcgaaggttccgatccgtccgtagccggttcctggggtgcagtccgtgaacagcccgtacagaccgctgcggtcggtcgcggcgaaggccaggtaccgcaccatggggtcgtccggccggccgatcgtgtgtgggccttcatcccagtacggcagatgctgcaccggagggatcccgtgcttcctcggcaacagccaggctgtttcctgtccttgcagggggagcccggtgtcgggttcgggtgtccagccgaagtcaccggggtgacccgtgccgttgcggaggcggtagaaggccttgaggcccggcgggacggtgaggtcgagttcctgctcgacctcacggatgtcggcctccggggcgggcggaggaagcatccggtaggagcgcggagcgtgccgctccagccactcctcgatcctcgcccaggcgcccgccacggcctgctcctgctgctgatcgtccgtcatacctgcgactctacgggtctcgtgccgcgctccggcaacctcacgaacctctccccctgcacaaaacggcggcggtgacatcggcgcgtgtcgcccggaagacgaggtcgtcgagcacgtcggagaagccgacggcgacggcgaacaggcgcaggcccccgtccgtacgaagccgctcactgagactgcttcgctggggcgcgggcggctggctgccgcttggcctcacggtcaagtggcggggtggtgggagtggacttcggcatatggatctccgtagtgaccggagacccaggtgtcaacgatgaacgtcagttttagacccgacttgcggagcgcgttcagcacttcagccgaggaatagatacgggagaagttccgtcaggcgcttcggctacgcatgcccgctgaggcgagcaccaccgtcggcaccgacaccaggaccgcccagcccaggcggcgcgactggtacgtggcgcacgtcgcctccactccgtcctccatcgacccatgcgcggggctcgagtcgttgccgaggacggagtggcactcggagcgggggtaagccgagctgatgtctggcgcgctggtcagcaaccacaggatcacgccggctccggcgcatgtcagaagccacgcaattgttttgttcatgccgtgactgtatgcctgcggcctgctcaaactctctatggtcggcgaccagttcctgaagcagttccagagtcacgtccttcaggtgcgcggtgacgtcgggtagtggccgggcgcttccccgggcagaccccgccgccgcgcgaactccgtttccgctgcataacttgggcagcagccacatcgcggcgcagagaccgggaccgcacgacctctgtgtgctcacgggcaggcccggtccccgcgaaagtcggtatgcgccgcaccacggtgctccaagccctcgttgacggggagagcgtgggcgaagcctgggggcggggtcgcccgactcaccgggcatgcggtgagcgtgcccggtgagtcccgccgcggcggccgcttccttacaccgcggcgatgccctccatgccggattcggcgaaggcgggcaggtctgtgaccgtcgtgaccttggtgagggcgccggtgcgtccgacgcggaagccgtcgacggtgccggaggtcgcgttctggacgtagacgaacttgtcggcggcgacggcgatgtcgatgacgccctgggacttcgcggacggcgcggcggcgatgcctgcctcgttggtcagcgcgagccggccccgggcgtccatgcggtagccgctcacggtcgagttgccggtgtttccgccgtagaagaagtcaccggcgcgttccagccagcacagggtgtcctgcccgttcggcaagggcttttggaggacttgcagctccccgttgcgacggaccttgtaggtgctgacggtggactcggcggcctcggcgaccagcatgcggcccgttttgtcgaaggcgatggcgaacggcaccatgcccgcggacttgttcacgaccggcttgtgcgccgggcggccgtcccgaccgatggggaagacctcgacggtgttggccgacttggtggtgacgaccaggttccggccgtccggagtgaacgccgcctggcccggcgagctgctgaacagcggcaccttctcgttcttcagccccagggtgcgcaacgaaccgctgagcggcttcaggcccatcgtggtgattctgaaaccctggacgcttcccgcgccgcccgcgttcatgacgtaggccaggtcgcccgagacggcgatgccgacggggaagtccccgcccgtgggcacggtctggcggtctgtgagtttttggccgtgcacagcgtacgacgtcagggtgccgctgccggcgttgagggccagcagccgcccggaacgcctgtcgtagaccagcgatccctgcgatgccagcgagtcggtgggcgcgtcgacctggtcgccgcccttgccgcctgtcgcgtacttccccgcggcggtcagcttgccgtcgtcgccgcggcggaagacgtggatggtgttcccggccagctcgttgccctgcacgaacacggcgtggtcggccttcgacgcagtgcgcggggtgggcgagacctggtctgccgaggcgatgttgaccgtggccaccaccgccgctacggctaccgtgccgccgccgaagacggtcgccctcttgtgcagcgtcgacctgcgcctgttgtgcctgctcacgtgtggctcctgtgatccgggggcgtgagtaagcagagttgcggatggggagatgacaatgaaagcgaacgacggccgcgtcagactctcgtaagaacccaacgggcctcggcacacgctaatttgacgtgtcggccatcgcagtcacgtgcgtcgtgggcctgctcgccgtctggggcacggccgatccacacagtcagctggcttcgtcgctctacccggcacgcgtgtgatcgatgaatgcggtcaacgcgtccacagtggcgtcgggctgctcgtcgggaatgaagtgcccggcttgtgggatgacgacgccggtcacgttctctgcccaggggctgatggcggcggccatgtcggggatcgagccgtgggagctggagatgcccaggaccgggatggtcaagtgccctcgtcgagcgagagtgtcctggttcttgcgtgctgattccgcggcgtcgcggaagtaggcgagcgacgctcgcagccctcccccggctgcgatggctgcggcgtagtggtcgatatcggcgctgtcgaacgtgttcggggacagtgtcttgaccctcaagaaccagcccacgtagtcacgctcgcggccggtgatcagcgtctcgggcagttcgggcaccaggtggaatgccaagtgccaggtcttccaggcccgttcgggatccgtcgggatggcgtccgggagggtgattccgggaatgccggcgtcgagcagggcgacaccgtgcagccggtctgggtacctcagggcgagcgagaaggcgacgcaggccccgatgtcgtgggcgacgagccagtacttcggcacgttgagcgcggtcagcgcggcctggacacgtgaagcggcggtgtgcgtgtcgtagcccccttggggacgatcggagtggccctgtcccggcaggtcgaccgcgatcacgtggaagcgctcggccagacgcggcatcgccttgtgccaagcccaccaggtctgcgggaatccggcgagcagcacgacggtggggccgctcgaccggccgccttccacggcgtgaagccggatgccttccgcgtcgacccagcggtgcgtgaagcccgcgaggttgcgcagcggcagcccggggacgttgttctgctcgggagagcggttcggggcggcgtcggtcatgcctcgagcctaccccatcttggaccgttcagtacaagatgaggtggggccgaggctgcgccgggggtgcggtggctcgctgatgccttccgtgaagtcatcagcggcgttccgagaaggccgtccgacagcgtgacagttccgcgcacgcatcccgttcaccagccggcaccagcacactcacccccacggccttcctggtgaactcccctactccgtcgcagggttcaggatcaccaggaaggccgccccataccctgtaaccactccaaagagtgaccgcacaatcggggccgagggccaaagaacaagctgagcgcgcacgacccgcggctgcgccagctccgcctgagaccacctccttcgcccagcgggtggccggacttcgaagccgacgactgggcgcgggcccacgcccaactgtcggctttcgtcgcggagagatcacccgccacgtctgtcatggcgctgcttcatcaggacctccaccccgtaccgcagcgaatctcccggcttgtcgagcgggctgtagcgctcgcctggcacggccccgcgctgagcaccggctgccttctgttcgggctgctgtagccggcagcggcgtgcggcctgcgttcgctggctgagcgggggcagcagcccgtcgccgggccacaaagatctgacgccacgggccgcagggagcggccccgtcggcaggccgctcggggagatggatgtgggagagattacgcaagggctggagcgcgcgttgcgcactcggcccgttctctcgagcaccgaggctcgcccgcggtttctgctcgcgactcaccagggttctacaggagcgtggccgcgttgctgggtgtttcgcagcgcaccgtacagcgctgggtgacgaagaagcctcgatcgtcccgacctccgcccggcccggcggaggtcgggacgatcgaggaggcggtcctgatgcgatagcagccccaggtgcgggcccgcctgcgtgcccgggccgaagcggaaggcttcggcctccacatccgagcgcgcttcgggttcgcggctctggcgggggtcctcggacgatccgcgggtgcggtgggccacccagtccctgccgggagaggcggcccgtgagctgttcgccgtccgggacgtcggcgcgggcgagcagcagctggtgatcctcgcccgtgcactgggtcacgcctacttccgcgacgggggccgacgcggccaccgtctgcacatcgccttcaccgacatcgagttcgccggcttctcgaccggatgacctcctcgtccggcgtaccggcgccggacgacgcgtccgagcaggcgacgggtcctcgtgggcaacggtcggctgcccggaccttttggcagagggcgccgctggggaccgggtttcgtacctgcccccccggttatcgaaggcaggtacgaaagccggtccctcggagggcatccgtcggcttccctcctcatgttctgtcccggccgggacagaacatggggagcggctccgctgttaacgagtgctcgtggtgtcgatgtcgacgatgtggttgtaccgctccaccagcacgaaaagcttggtcttctgcgtcgtctccccgctgccgaaggtcagggtgacgatgacctcatggccgttgcccacggtgccgttgtcggtcgccgtccactgcgccgggatgttttgggcgcgcaggacgccgtccgccgcgttcgtcttctcccaggctgccagccgcttggcgaagtcgggcgtcaggtagtggttgcggagggccgtggcgagcgtggcgtccgggtccgtgtagtcgcccttcgcgtcgatgtacgcgccgtagaagtcggcgacccgggtcaccgcttggccgggcgtgccgctgaccgactgtgcggtggacgcctttgcgggggcatggacggccgcctgtgccgacacctgtgtcgacacaccgagtccgacagccaggacgaggccggcggcgacggccgcgcggcggcccggacgacggtgtgcggaggacttcctgttcatgtgtgtcttccttttctggtctgtatgcggttgctcttggccggttccggctctcgtgccgaaggcgcacttgtggccacctcgtccgcctccgagtcgaggacaggacggcccggctgccggatcggacaggagtgggcccggtgttttcgccccggggccgtcgtgtggcggcgggcgccgcggggtgccgaacgccgcacctcgggcattcgggtacacgggtgtcccggtacgcaggcgcaggtggtgtgccgttgctcattcctgctgaactgcggaagcgtccgccggccgttcgggcagattcagcaggtggaactgctggagatctttattccggtgacgctgtaagcgttcgcgaacacggtttcggaattcggcaccaggcagatcgagttcccgtcctggagccgtaggtacgccacgtcgtcgttccgggtgttcacgacgtggtagtgcggccgggatctgaccgtctggtaggaactggtgacatcgcggtacttcgtgatcggtgtgcccgcgttataggcgtcctcgtccacgtagaagcagacgtaggggtacgggcagccgtgggtgggggactccgcctgggctgccgatgcgccggtcacggacatggctgcgacggccacgctcgcgcctgcgaggcctgctgcctttcggatgacggacttcatcaaacctccaagaatttaagtagatcgtctgagacggcagctgtagatcgtgatccgttgcggatgccgctggtcagcaggggcgaagcccggtgctgcgaggcgtacggcaaccggcgtcgtgagcgtgtgtgacgacgtatcaagcgcggtggccatgaaggcaaccgttggtgcgtgcgtatcgggacgtcgcccaacgccggttggtccctgtagccgtggtcggtgcgacacccagagcatcggcggtcaccggagtccggcgcaacgactgccggccctttggcgacggtggaaccatcccagcccatctgacgtgcagggatatgagtgcctgggatacgggatcgtgggcgggacgacggaggaacggtgtcgatgcgggacgatgtcgaggagttcgcggcgcttctgcggcagctgaaggaccgcacggaccggagctacggctcgctggcccgccgcctcaacatgaacacctccacgctgcaccggtactgcgcgggcgaggcggtgccgcaggacttcgcgcccgtggagcggctcgccgccttctgcgaggcgacaccgaaggagcggctcgagctgcaccggctgtggttgttggcggtggaggctcggcagcgggtacgtacggccggcccggcggaagcggcggtgtcggcggaggcggcggtgccggcaccggacacggacggggcactcgccgaggacggggaacccgccgaggagagctgctccgcggagcagcccggggacggtcccggcccggacgagcccgctccctcccccgctccccgcccctggttccgccgccgacgggtcctggcgtccacctccgtcacctgcgcgctgctcgccgctctgggcaccacgtccgccctgtcggacgaccgctcctccgaggcggacggctctcgctccgcgggcccgcgggcggccgcccccggcgcatcccaccgttcggcgaaaccgtcggccggcggctccccctccccttcccggagctttgcggcgcccggcccccggcagaaggcccccgccccgtccggcaccggcagcggtcccaccccggccgcgaagcctgccaccggcctgcccctcgcatggagcgccgactccctggtctgggacaagggctgcgaccacgactacgtcatcgacaagccgcccgcgcaggtgcctccaccgccggtgcaacaggacgccggggcgtgggcggcgacgcagggcgcggtgcacgggcggcatacgatggtgcagatctccgtgcaggggcagtcctccacggccgtggtcctcaaagcgctccacgtccgcatcgtcagccgcggcaacccggccgccgggagcgcctacgccatgggccagggctgcggcggcgacctcacgccccgccgcttcaccgtgaacctcgacgccggccgccccatcgcccgcccgaaggacggcgccgacatcggacacaccatccccgccgtgcaattcccgtaccgcgtctccgccgaggacccggaggtgctgctggtcgacgcgacgacacaggcctacaacgcccgctggtacctcgaactcgactggtcctcccagggccgcaccggcacgatccgcatcgacgaccacggccgcccgttccacaccaccagcatcaagggaatgccgcgctactggtacggcacgaacaacgcaggcgggcgtgcctgggtcccctacgacagctagcgctggattcctcaaacggtgtacacatatcgccgccgtagccgacgggtcggcggtgcgggtctgccccagacccagggggtggcacgggagttgagctggctggtcgccagggtggtggcgtatgcgatgtcgtcgaggttggcgaatgaccggccaggcgagggcggctttgcggaagatgcgccaccagccttcctgcaggtgtcgcgccccgtcctcgatgtccctggtccagctggtggcggacgtggccaccgcgccacgggttccggatggcgaacagggggctcggcctccggcgcgagcacacctggtcggccccggctcgtgcgcatgtgtgggcgcacggaacatgtgcaggctcaagcccgaacaggtgccggcgaccgcgctggggccgggacagaaggtgcagcggtgctgcgcggatgagtcgggccagatgctccgccgccgaaagcacgggcctggtccccgcgcggtcacatgccccgcgtcggagtcagcgcctcggactcgggacgcatctccctggcgggcgtggtctgccgcagggctggtcaacgcagccggctgccggtgccggcgtggctggccggcaggggcgggcagccggagggctactgccacctgcagatgatcgacgcggtccgctacctggtcgacaacggcatcgagtggccggcgatgcccgcggacttccccgcccgggaccgcgtctgcgccgtcttccgccgccggcgtgaccaccagctgatcgccgggttccatgaccggctgcgcggccgggtccgcgagagcgaggccggaacacggaaccgacggccgcgatcgtggactcgcagatcgtcgccctcggtgccgtcaccgcagtgctgatgccccgccagggccaaacggccgtaacggaggccgagccggccaccgccacccaccaggcgcggtccgcggtcgccgtcggcgaatagcgcacccgcctgccgtgccggcccgggcccgacgccttcccccgccgtcgggcccgggcccttctgcgacaccacggtttccgtcgcggcctcgtcagggccagatgaatcaggccaggcctgcgcacagtgcatcccaagcccaaggaaaggagtattcacgtgatagttctcgtgaatgtattccaagtccacggatctcccaccgcgttcgagcgcgaattcgcgaacgtctccgaatgcatgcgggcacagcccggatttctgcaccacaggctgctctgttcccagggcactgactcgacctatgtgaacgtcgcgcagtggcaggacgagcagtccctgcgcgacgcgctggcccgtcctgaggtcgtcggacgcctgcgtccgacgacggcgttggttcacctatatgaactccgcacacatggatatacatgtggtggacggcgtgcaagactccttcaactcccttaccacgctgttcagttggagagaggcaggtacccgtgtccatttctcggcgggctgttttggctacggcggccggcaccgcggccgcgtatgcgtcttcgcctcagtctgcgcaggcgctggccgagcaggtaccggcagcgacggtgcgcacgctgcgtgcggcggccgactacgcggtggagaagatccgtgctgtcgcgccaggcgtgagcgccttccctgtcgggacgaagttcgagaagtgggtctactcccaaaacggtgactgggtcggcgggttctggccgggaacgttgtggatggcctggctgtacagcaaggacgagcaactccgcacactggcgctcgagtcggcgaggaagctcgccccccgtcagcacgacaccagcacgcacgatctcggtttcctgttctctccgtcgtgggtcaccgcatggcgcctgacaggtgacgacgtctggcggaccggtgccgtacaggcggcggactcgctgatccagcggtacaacccgcgcggccgcttcctccgggcgtggggcgcactgaacgatccgaacaacgcagggcgcgtcatcatcgacacgatgatgaatctcgacctgctggcattcgccagccggcagaccggcgacgcgaagtacctcgacatcgcggtggagcatgcgaagaccgcccagcgggtgttcccgcggccggacggatcgacaccccacgtcttcgacttcgatccggccaccggcgccccggtcggcccgggcaccgtgcagggctacagccccacctcgtgctgggcgcgcggacaggcatggggcgtgtacgggttcaccacgatctaccgccggagcggggagcgcccattcctggccaccgcgtgcaaactcgccgactacgcgataggagcgctcggcgcggactacgtgcccgtatgggactaccgcgcgccgcagcagcccaacgacatcaaggacgcatcggccggcgcgatcatggcatgcgggctgctcgacctgtccgccgcgacgggcaggcagcagtaccgcacggtggcactgcggctgctgagcgcactgtcgcagacctgcctgacggacaagtccgcccgcgcgcaagcggtggtggcccgctgcacccgcaaccggccggccgaggacgggatcgagatctcgctcccctacgccgactactacctgctggaaggcatcttgcgcgtcctgcagccccaagatgtcgaccgggcgatcgacctgtctgctccctgaccggtcgtcgcgcaatggtggatggccctggcggggcagtggggcctcgagtctcagcggcagcctcgcgcgggcgggagtcgaggccaccggtgcagggacgtctgccggccgtgccgggtgtcaatgacgttgctgccgcactccggcgattttctttaaccgcccgctggccggcgacctcacccttggctgcgacgtgctggccgtcaccggcgactgcgaccagactcccggccatctgcgccgccggacccggcacctcctccgagcaggcccgccgcctgctcgccgactggaccggcgaaccggccggccgggaggcgatgacgcccggcgcactgctgtaactggtcctaacaaagccgctgtacgtggcggtgggtgatcaggcagacggcgagtccgaggaatgcttcgtggatgtcggcgcgtcgttcccagcggatgcgaaggcgccggaagccgtggagccaggcgatcgtgcgctcgacgacgtagcggaagatgcccaggccggtgccgtgaggctcgcctcgcttcgcgatcacggggcggatcccgcgggcccggagcaggcggcggtatttgtcgtggtcgtagccgcggtcggccagcagcgcatcggggcgtcggcgaggtctgccgacccggcccgcgatggccgggatcttgtcgagcaggggcagaagttgggtgacgtcattgcggtttccgccggtcagcgacaccgcgagcgggatgccctggccgtcggtgatgacgtggtgcttgctgcccggacgtgcgcggtcgaccgggctgggtccgcttttgggccccgccgggcagccctgacgtgggaggagtcgatcaccgcccgggaccagtccagcttgtccttcgatcgcagtttctccagcagcagcacatgcaaccggttccagacgccggcctcgttccaggccgccagacggcgccaacaggtcatacccgaaccgaagcccagctcctggggcaggtactcccactggatccccgtgtgcaggacgaagaggatcccgcacagcgcctgccggtcaggcactcgaggtctgccctcgaccagcttcggcgcaggcttgggcagcaacggctcgacgagcgaccacagttcatcgggttacctccgaggagaccccggccttcaggccggggaggaatcggactcctgcggagcagggcagggaaaggcgattcgcctccagggcgaatcggcgcccgccacgacgcatcgcaggctcacaaactgatggcctatcatgtgagttatggccactcgcgtgaagcgggcgttcaagtaccgcttctgtccgaccgatgcgcaggcagcggagctgtcgcgcacgttcgggtgcgtgcggaaggtctacaacctggcgctcgccgcccgtaccgaggcgtgggcgcggcaggagcgggtcacctacaaccagacctccgcgatgctgaccgtgtggaagaagaccgaggaactggcgttcctcagcgaggtgtcgtcggttccgttgcagcaggcgctgcggcacctgcaaggggcgttcgcgaacttcttcgccaagcgtgccaagtacccgcggttcaagtcgaagcggaagtcccgcgcctcggcggagtacaccagctcggcgttcacgttccgcggcggccggttgaagctggcgaagatggccgggccgctggacatcgtctggtcccgccccctgcccgagggcagtgtgccgacgaccgtgaccgtgtcccgggacgcggccggccgctggttcgtgtcgatgctgtgcgacgacccgacggtgaagccgctcgcggccacggatgcggcggtggggatcgacgtcggcctggaccacctgctgaccctgtcgaccggtgagaagatcgccaacccccggcacgaacgccgcgaccgcgcccgcctcgccagggcacagcgcacctgtgcccgcaaggagaagggctccgcgaaccgggagaaggcgcgccgcaagtccgccaggatccacgcccggatcaccgaccgccgcagggacggcctgcacaaactgaccactcgactcgtgcgcgaaaaccaaacgctcgtgatcgaggacctgaccgtgcgcaacatggtcaaaaaccaccggctcgcccgcgccatcagcgacgcggcatggagcgagttccggagcatgctggagtacaaggctcagtggtacgggcgggacgtggtggtcgtggaccgcttcttcccctcgtccaagctgtgctcccactgcggcaccctgcagggcaagatgccgctgcatgtccgtacctggacgtgcgactgccaaacggtccacgaccgggacgtgaacgcggcgaagaaccttctggccgccgggctggcggtgacagtctgtggagctggtgtcagacctcaacggagaactccgggcgggcagtcggcgacgaagcagaaaaccccacggcgcgagccgtaggattccccctcgtttacgagggggaggaagtcaacggaaacgatccaaggccgcgactgacgtttccccacaaccagaccaacgaacaggcaagccaacagtcacatgatgacagcttttgttagagccagtaaggcaccaaccgcatgatcaagctgaccgtccgcacggcccacggcttccgcaaccccgccaaccagcgcctacgtacacgctgcgtcaccacccgccgagcccgcggacacctccgcaccgctcgaccttgaagaccccccttacggatcgtgacaggacgtcagcggtccggcgcaacgcactgctcaacttcggagactctcaggattgtgctccggcggatcaggcgtgcggcagttcgctgacggccgggcgacggcctccgtaggaggcgaccaacgcgtctgccacgatcgccgcgtctgcctcggccgcgtccgccgggtactccggcaacaggtcgtcccagatgaccatccacgacccgtacagttgggcttgcccctcgggacgggcgaagaaccagatgtgcagatgggcgccaccgtctccgatgcggtagacgtgggcccgagagatgtgcggcagtgcttgcacatggcgggcgatgtgggtggtgagcacccccagttcggcggccagttcgtcgggcaggtccgccaggtcgaagtgatcgcgtggatgcagcatcagcaccagcggcacgccgactcccgtgatccgggtgagccgccaacggtcgtcgagccagatcccttcgtcccggctgcggcacgcgttgcagtccaaggggtcctcgccgtgccgcgccggttcgggtagaaccggcgggcgcagcggcgcgacgcgcaggccgtccgcctcgaacggactgatgtcccaccccgtcatacgggctagcgggagccgtcgctcaccatccgcagcggtacgtgcgtgggcgtagaactcgtcaggtcgcagggccatgggccgaagactactgttgttcgacggcaatcagcgcctacgcatacgctgcgtcaccacccgccgagcccgcggaaaccttcgcaccgctcaactttgaagaccgctcaacgggcggacaccagtggagtggtggtggagacggacagggtgctggcgttccaccacacccggccgtcgtattccgttcacatcgtggtggttcccaagggaccatgcgccgtcgctgatcgacttcggggccggcggtgaggagctgctcgcagaagtcatccgggtggtgcgcacggtggccgcccaggtggagcagcagcacggcgcgtgctcggtgatgacgaatctggggctgtatcgggagtccaagcaccagcactggcacgtcgtccaccgcggcgaacccaggacggaggtcccgtagaagtacggggctcctgccgtcggggtacggcggccggcccggccggctcagtctttgtccttcgggggcagccccgccacggcctcggccgtggcctcggtgatgcggtccaggtcgagggtcagtccctgcagccatgcctcggcgtcgtagtagaccggcggaggcggagcggcgtgcggccgggtgtcctcggctctgcgggggccggggcggccggacggtgccggcggcgggcgggtgccggcgaggagggtggcgaccagctcgtactgcccggccagttcggcaccgtccctggccagttccgcccggtatgcgggagcgggccaccgggacgcggccgggtccccgggctccagcaggcgcctggaaccgcgcagggcgtgatgcccggccatcagcgtcgcctgccagtccgccaccggtgtgccggcccggcgcggctcgctctggtactgcgcgaaggacgactccgccagcgtcagggcgtgctgcagcgagggccggccgcgctgtgcctgcgcatggccctgggtgaggaacgacgtggtcgaggtgacagtggaggcgatggcgcccagcagcgcggcgatgtctcggcgcagttcctcctgggcgccccggggccaggcgagcagcccgatcaccaggccgatcacgctgccggtgagaacgtcgaggaagcggaactcggccagatgccaggtggccggcgcgagctgggcgaagacggtggacacgaccagggtgaacattccctgcgcccagcccacgccccgtgtcggcccgatccagaacgtggccagcatgatcaccggcagtgccacggcgtaggccgtgttgttccctttgacgaacaccagcagggcggcggcggccagcgcgcccagcagcgtaccgatgagggcctggcgtacgatcgcgcccgtctgcgcggccgtggtgcggatcagggtgagagcggccagcatggcccagaatccgtgcggcagggagtcgacgccggccacggtacgggcggccgccagggccaggctgatgcgcaccgcgttctggaagtacaccgagcgggggctcaggtgtcccaccagacggtgcgcccacaggcggatcgtgctgtgtcccgcgtaccagaagctgccgtcctgtgtctcggtgggcccggggcgtcgccccagggcgagatcggcggcggtcgccagtgtcaccgcggcgtaggcggcttccatgagcatcgcctgacggtgcatcactgtgctggtggtctcaggtgtcgcgctgtctgccggcacggtgcgcagacgccggtaggcggccagggcgtccggcagccgtcccgggccggccggccggccggtgcgcagcgcggcggcggtccgccgggccgacgacgcgacctcgagcaggagtgcgagggtgtgggggtgcgggcccccacggcccggccgcgggacctcctgcagccgggccagaaggacacgggcggccatgccggtgtgggcgagcgcccgttcccgcggtcccggtccggccgggcgctgcgactccggtacgtggaaggggcgcagcgcttcgccggccgaccgtgccgcgctgcgggtttcgtccgaaagggtccagggcgggtgggtcagttcgctcgcgcagcgtgccgcggtgatggccgcgtttgccgaccgggtccggtaggaggtggtgggcgggtcgggcagcagcaggctctcggcgagcacgagcagcaggatgccgagcgtggcgccgcccaggcgttcgcccagtgtctgcggcgcgtacggggggaagcagggcaggatgtagagcagttgcaggcccggggccgcaccggccaggcgtggaccggccgccgccgcgaacgccagaaggaagccgatcaccagcatccccgccaccgcggcccaggtgtgtaccgcgagcagggtcccggctgtcacgaggatccagccggccgggagcacccggatgacgacggccgcgcgctggcgcccggtgccggggatgcgggagaggccggccatcgccaccgccgcgaagagggcgtacgtggcggtgacgggctcgtgcaggccgtagaggccggtgtagaaggcggcgacggatgcggctgtcacccggacggcgcgcctgcctgcgcaggccgaggcgccggtgccgtgccgcagttttgtggcggtccggcgcagtgccggggcggggcgcggacgtgcccgggcggtggtactgccgctgtccgcctcagggcccatggccggcacccctgcccgctcgtcgttcctccaggatcacatccgctccgaaccgccgcacggccttggcggtactccccttgtccgcggtgccgcggtgccgcggtgccgctgtgccgcggtgccgctgtgccgctgtgctgaccacggccggggcctgcccaaagggcaaggccctgtccgatgccacccgttacggtgccggcgagagcggcgaggaggagcggcgacggcacccgggggccgggagggccccgccacaggcaggccgggcagctgtgacgggcaggggctgcgctgccccgggcgctctcgacgttctgcgggccgggccgggctggtccgtccgtcgtgatgccgacccggcacagcgagaagccccgcccttcaggacggggagggagtcaccgcgtctgttcgggtgaggtgccgggcacagggaggtcctcgcggcgcgggcgcgggaaggatttggtccatgcagaccgatccagcagaaaccgtggagcgcttccttcatgcgctgagcccggcgagccgggaagttgtccggcagttgccgcgcgaccagcaggagatgatggccgcgtcgtgggagcgtcatctccgagatgacaccagtctgctgacgctcagcgagctcgacccggcctccgccgagcaccgggcggccgaagacgtcgtgcaggacctcctctgaggcgctgcccggtgtgctccttgcggcagtcaccttgggcggcctcaccacccccggcagggtcagaccgcggggtccaggctcaggcgcatgcgaacgtagttcccgttgcctggaccgggccggtggtgtccgtccggcttccatccgtgccgggcgtagaaggcttgggctcggctgttgcgctcccatgcttccagtacgcctgtgaccagtgacgcatcgcgaaggacccgcacgaattccgcgtgcagggcgctgccggtaccttgtccccagatgcccgggcggacgtgaatctggtagagctgtcgggcagttgcggcatcgatgtcagcttcgtggggagggcccatcgacaagatgcccaccaactcaccttctcggtccgcacacatgacagtgcggtcgctggagtggacggcccgcctccagctctcccgccggctggagtgcccgccgggggaggcgagctccacgtctggcactccgcctgcctggtagtacgccgtgcgagccagcgtatgcaggtcagtaatgctgtccaggtcgccgggactcgcagtccgcacgaacgtccgagaagtcgtcacggtcaggtgacgcactcatctcgcttcctggttccccctcagatgccgggatcagaaagcaggtgctgaagggcgggcaggcatgccccgtgaccggggctggaggggatccgcggggacctgcaccggcggcgcaacgcgagcaggtcccgcacccagggtgcgggacctgctcttgacggcgtcctggaatcagtcgtagacggggccgaccaccgtgcagaagctgccgatgttctgggtgttgccctcggtggagatgccctgaacgggtgcgaaggcggcgccgccggcgaagtcctggtcgcagttcacggcctgcaggttgccgatgatgatgtcggccgggtcgtcgagcccgtggccgccggctgcgtgggcggccccgccgccgagagccatgccgccgaccatgaccgctacggccgcggccttcttgatcttgttcactacttctccggttttttctgggcgcgcgtctgaatccgttacggagtgtattcggacaggtacagaatataacgggcagtcatttactcctgcatttccggcgcctccaattgggtgcattaattgacctatatacgttttagtggtactggagtcgtggcggaccgtgcggtgaggcacatgacaacgtcacagtccgtttcggctgtctcgcgaacacgacggcatggcaccggatcaacagccttcgtcccatggcaacctgcgggccggaacaagtgacttggagccggaggtgcacggcccgtgccggcgaacatcaaccccaccgtcagaagacgccgcctgggagccgagctccgccggctgcgcaaggccagtgatctgacgagtgcgcaagtggcagagcggctgctggtctcccagcccaagatcagcctgctggagaacggccaccgcgccatcagcccccgcgatgtgcgcgacctgtgcgagctctacggagtgaccgaccggcaggtcatcgactctctgatgcggatggcccgggaatccggacagcagggctggtggaacacctacggcaacatccccaacagcgtctacatcggcctggagacggacgcctcctccattcacacctacgagcccatggtgatccccgacctgctgcagacacccgcctacgcccacgcggtcatcgagacaacggtccccccgatccccgcccaacaggccgacgcgcgcctcaaggtgaggctgcgccgtcagcaccgcatctacgacccggcccgcccgctgcgtctgtgggtcgtcctggacgaaccggccctgcaccgcgtcgtcggcaggcccgacatcatgcgcgaacaactcgagcacctgaacgcactcagcgccgaaccgcacatcaccgtgcaggtcctcccctacaccgcgggagcccaccccggccgccaaggccagttctccgtcctgaggttcgccgacagccccgaggcagggatggtgtacctggaaaggttcaccagcgacctctacctgaagaaaccctccgaagtgcagcagtacagcatgatgtacgaccacctccaggcccgcgccctcagccctgagggcacccgcgacttcgtcaccgacgtcaccaagtcacacatcgacgtggcgagccgtccctgacaccgacgcccttcgacgatgcggggcgagcgccggcagcagctcgcgcaccgcatctgcccacccgtccggcggcggcctacggcccggtcaccgaaaagcgccgctcgccctgcggcaggagcggggcaatcccacggcccgtccggcccgctccacggccgatgccccgcgcccccggccacaccttcagcgcccgctccgggcccgccgaccagatcccctccgcctcaccgtgtgaggccttgcaagcgggccgggtacggcagacggggcgtcagccaccgcgccagcgaggacctgacccggtcgacaccgacgctggtcttgatgccaccgagatgaatattgatcaggccgcagcaatcgtcgcggcagagcccgtgccccggcggagtcgggggtaccggcgccgcggagacctggaccgtggtcatgctgttcgaagcgaagcagttcgcgtttccgttgtacgcggccgtgatcgtgtgagtgccggtggtggcgaaggtggtcgtgtactgcgcgtgcccgctcgagtcgacggacacctcacccaggatgtctcccccgtcgaagaacgtcaggccgagaaggactctgctggggtcagcgctacaggtcacggtcgcggtcagtgtcacgggtgccccgacactcgccgctgagggtgatgccgtgaccgtcgtcgacgacgacacagccgccgctgccggcgaagcaaagcccaccaccgcaaccagcgccccgatggtgcccgccttccacactctccggtcttgccaacgtctcacagtctcgactcctcgatcggtcacaggacaaaggtccgccgcaaccggtccgggagcctcacgctacgccgagggctctcgcgccccagggaggcgccggcccagtcaacccacttgggccaacgggcacagcgggggcgggaagcgttgttcgcagagtcctggacggtcacgggggacggctctctcgtgcaccttggcacggctcccccaaccctgcacctcggcccggcccgcccggcatcgaagcaattcgtgccccggccggtaacgggaccgggcggacagccccttgaggaagaggccctcccgcgccatccaagtgatcttgaggacggacctagatcacgggaggggcgacacgtgtgtaggtgagggagttgctggtgccgccggccgtggtcacgttgaccaggacggggccgggcacccccgccggggcgtacgcggcgaccgtggtgtcggacagcacggtgaaggccgcagatacggcaccgaaacggacggcggtcgtggtggtcaggccgctgccggtgagcgtgacaccggctccggcgccggtgggcccaaggacggggacaagggagctgaggaccggtgacgccacatacgtatagatgaccgagttgctgacgccgcccgggcccgtgacggtcacggcgaccgagcccgttcccgccggggcgacagcggtgatctggctgggagagttgacggtgtagccggtggcgggcgtgctgccgaaggtgaccgcggtggctgcgctcagatccgcccccgtgaggatgacggtggtgccgcccgaagccggcccctggcccggcgagacggaggtgaccgtgggcgcgttgacgtagaagaagtagacagggccggtcgtaccgccaggcgtggtgacggtgatgggcacggcgcctgttcccgccggggcgacggcggtgatctgtgtggcggagttgacggtgtagccggcggcgggtgtgctgccgaaggtgaccgcggtggctgcgctcaggcccgttccggtgaggatgacggtggtgccgcccgaagacggcccctggctcggcgaaacggaggtcagggagggctgtgccgcgtaggtgtaggcgaccgagttgctggtccctccgggtgttttgacggtcacggcaacggtgccggtgccggacggggccaccgcggtgatcttcgtcgtggagtcgaccgtgtatccgagggccggtttggtgccgaacaggacggcggtgactcccgagaagccgctgccgttcagggtgacgttgttgttgcctgccgcagggcccgtactgggtacgaccgaggtgagaacaggaacggcggcgacaacggcggcgggccggactgctcctgccgcaggagggctgtctttcacggtgtctccgtagagtgtcgggcgggccgggaagggccgaagagagctgatcgggctgccctgcctgtgtcttgcgggccgcgagcagagggcccccggcccgggtggggcttacccgggccggagactcggagacgggcgggcccttacgggcttccgcgtccgctccggacggggccggccactgagagggccggccgctgaggggcggtcagatgccggggccggcgaggtaggtgaacgcgtccgtggcggtcgcgctgcccgcgtcgttggtcacgacgacatcgacgagaccggcggccccgggaggcgtgacagccgacagcgcggtgtcggagatcaccgtgaagggtgccgggttgccgtcgaaggtgacctggctggtgctggtgagaccggtaccggtcacggtcaccgaggtgccgcccgacaccggcccctcgtccgggacgaccgacgtcaccgtcgggacggcgacataggtgtacgagagcccgttgttggtaccgcccgcggtggtgacgctgacaccgaccgagccggccgcaccggccggcgcgacggcggtgagctggctgtcggacaccaccgtcggcgccaccgtgttcgcgccgaaggcgacgctggtggcactggagaagccggtgccggtgatggtgacggtcgtgccgcccgcggtcgacccggaggtcggactcagggtctgcttgaacggcgcccccacgtagtagaacggaatggggttgctcgtccctcccggagtggtcacggtgacaccgaccgaaccgctgccggagggcgagaccgcggtgaccgtggtgggcgagacgttggtgacgttggtggcggaccgcgtgccgaagcgcacggcgctggtgccggtgagattggtgccggtgatggtgacaagtgtgccgccaccactggatccttggttcggagagatgggcatgagggattcctcctcgcccggaatgcggtacatttccgagcagtgatggggcgttcggtccgcgtacgtccccggtggggcgagtcagctctcgtgtccactggccaggtggtatctcgatggccttgcgcggatgcccggtcaacggtctgcagccgtcggcgctttgcgcggggcctatcgaggaacacagcccgtctgacgtcacctgacgcccattcaggggcctgcccgcttccgtttgcggattcgaatgccgctggtacggacacgagaagtaacccagaagagtgagctgaacgacaagggttcactcacaaagtcaaccgttcaggcgagcgccacaggcgtgaaacggggcgcctcggcagcgcattgacgaaaaactgctcataagccaatccgccgcagaattcaagatggttgcggtggtgaacccacacccccccgggtgaacagccacgcgggctgacgcacaacaccccggcccgtagcggcagccggatccgcgccacgcccccagccgccggggcgctgcggtcgcctggagcagtggacgccgcccggccggtagcgcgccggcgccgtccgcgcacccggaaacgaccaagcaccttgaacgccgccgtcgctcaccgcgcaagcgagccagccttcgtccggcgccggccggcgaggaactgcacagccccccgtacgcgcacgagtgaggcccggaggccatcagcgtccgcgtacatccgcgccttggccgggcgccgtgccggaccggcccggaaggaaaaccgcccggttggcgggctgccgggccctggaccgggactgcgacggcccgaggacgacgcgcctgaccccaccgcccgagcagaagcagtacgctcagcgacctgcacgcttctccgagcgcaggtacgagaagtgccctgtccccagcagctgcaatgccggggacagggcacttctcgtacggggtgccggccgggccggggcgagatccggcgccgggagcggacccggaccaccggggtacggccgcgccgactccaggtccggacggccggcggcgtcatcggcactttggcctcgccctcgagggcgtccgcgcggccccgctcgacctcgtcgtgcagctcgggacccagatggcccgaagcccgatgctgaagctgcggtcgcgatcggcccggccaccgcgctccttcgagtctcccagccccctacggtccgatccgccgtagaggcgagccggcggctccaacggcggcggcttcaaccgcccgggctgctgtttcagttgccgccgcactggccgtacgcgcaggccgtcggccagatgcccgtcgacaggggcattctgccgggcaccgtccgcgcggagtgcgccggcggtcggcggtcggcggtcggcggtcggcacgggaacgggaacgggaaccggcgccaacggtgaggtggttcacgactccggtatcactaaaacgtatatagattaattagtcgcactcagtcggatgtgccggaaatgcagtgataagtgagtcgcgtgctatcttctgtgactgtccgagcacggcccgtaagggctctgggtgcgcgaagaaaacggagaagtaatgaacaaggtcaagaaggtcgcggccgtagcggtcatggtcggcggcatggctctcggcggcggggtcgcccacgccagcgacggcccggacgtcgtcatccccaacctgcaggtcgtggactgccagcaggagttcgagggtggcgccgccttcctccccatccagggcgcggccgccgtcggcgacaactcccagaacatcggcaacttctgcacggtggtcggccccgtcgaggactgatccaggacgccgtgaagagctggtcccgcccctttggcgcgggaccggcttgcgttgcgccgcctgtgcggccatcgcggcgcccgcagcaccccgtccactcaccaatacgcccgggccagtacagccgaaggcgagctcaagtccgccccgcgccctgcccggcgcgccgtcccgcggtgcacggtgaccgtcaaatgggcgccgcattcacccccgtgcgagtcactggctttccggcctttcgggtcccggaggagctgccccgctattcccgcactcaggtgcgagccataacgaacaatactttctggtcacttcagcccccatgagaatatgggcccgttcggatgaccctttcgctcgtcaaatacctcacggaaatggccgaagcgaagggaagggaagcatggctgactgcagccgtcttcagttgcgctggttcaacggagagcgccgggtcaaggggagtgccggccgcggtgcgcggtctgttgtcgcattccgtgtcggcgggcgcggcgtccaggtcggtgctcgggcagatccagatcgtcctccgcatcgccgagtagtccgcccgggcccgggcggacttatcggatggccgccgggtcgcctgcccacgcgattgccgagcggaccgtggcgtggctgaacgggcaccgccgctacgagcaccccccagaccggcagggctcaggtgttggcggcgccgtagtgcaagacctcaccccggggcagcaggtacccgatgtcccgctcctccggcagcctgcctgccatcgtcgatgcgctggtgcagccggaggcctcgaagccgatgacgcccagactgaaggacgcgcttctgaaagcctcggccccgaccgcggcaagccagtcgtccgtggcagcggatctgaagaacggccggccgtcccagtacgcgacacccgcgtgatccagcgctcccacagggacgtacaagtccagccagtcgctgctttcgtcgcctccgcggaccgccacgcaaccgcacacgaccagttggcccgtcggcaggcggacacgaccgtaaaggtggccgaactcggccagagaggcgaccgtgcacggaacggcatcctgttcctcaggctcacggtccgactgcccaaagcaaccctgcacgtttgctgcggaccacagggcgctcaggactgcctgcagtcgggcgtcatcagtggatcccacctcgatggccaactcgtagtagccgtcggaccaatttgcctggtcacggaaggaagcggggctcgtcttgacttctccccctcctgaaggagggggattctcacggctcgcgctgtgagggtttctgcttcgtcgccgactgcccgcccggagttctccgttgaggtctgacaccagctccacagactgtcaccgccagtccggcggccagaaggttcttcgccgcgttcacgtcgcgatcatgcgtggtgccgcagccacacgtccacctgcgcacgttcagcggcatcgtgtcctgcagggtgccgcagtgggagcacaacttggacgaggggaaccaccggtccacggcgatcaccccacgtccgtaccactgggccttgtactccagcatgctccggaactcgctccatgccgcgtcgctgatggcgcgggcgagtttccggtttttgaccatgttgcgcacgctcaggtcctcgatcacgagcgtttggttgtcacgcacgagtcgagtggtcagcttgtgcaggccgtccctgcgccggtccgtgatccgggcgtggatcctggcgaccttgatccgggccttcctgcggttggctccgtcacccctggccttgcgggcaaggctgcgctgtgccctggccaggcgggcgcggtcccggagctcgtgccgggggttggtgatcttctcgccggtggacagagtcagcaggtggtccagacccacgtcgataccgaccgccgtatcggtcgcaggaagcggcctcacggacgggtcctcgcacagcagggaaacgaaccatcggcccgcgctgtcctgcgacacagtcaccgtagagggcatcgccgcctcaggcagaggccgcgaccacacgatgtccaacgggccggacatcttcgccagcgtcagcttcccgtcccggtagcaaaacgcactggccgtgtactcggcggacctccgcgacttcttccgggacttgaagcgcgggtacttggcgcgcttggcgaagaagtggatgaacgcgctctgcaggtgccgcagtgtctgctgcaacggaaccgacgacacctcgctgaggaacgccagttcctcggtcttcttccacgcggtcagcatcgcggaggtctggctgtagctgacccgctcctgccgcgcccacgcctcggtacgggcggcgagcgccaggttgtagaccttccgcacgcatccgaacgtgcgcgacagctccgctgcctgcgcatcggttggacagaagcggtacttgaacgcccgcttcacctggcccggggtcacgcccacacgctaacggggccacatgtggtgatcaaacctgcgggtcagagcactgggatccgccctggcggcgaatcccagcccgttgccctgctgcgcaggagtttcgtttcctcccccggctgaagcgggggtatccacgaaaggaatccgatgagaggcggcggcgtcccgccacagtgcgaaaccgccgcccaccctccgccccagcccttgctcagcctatcgaatttcgatagattcccatcgcaactcgatggaaggatgatgggccgtgggaaagctgacagtgcgtgcgctgcgcgccgtgctcgtggtggtgctcaccggcaccctgttcgtacaggcagggatggtgtgggcattggtcagcgggagcgacccggaggacggatcgctcccgctgaccccgctgcgcgtgatcacgatcctgggcatggtgtcggtccaggtcgccctggtctgcgtgtggcggctggtggcgatggtgcgacgcggaaccgtgttctcccacgccgccttccggtacgtggacggcgtgatcggcgcgatcgtggcggctgccctcgtgtggttcgcggtcacggtcatcaatgcgccgggccagcgggacgacccgggcgtcaccgtcatcatgggcgggattggcttggccatcctgggggtcgcgctcatcgtgctcgtgctgcggatgctgctcgcccaggccgtcgcgcgcgatgtccaagcggcgcacatgcaggccgagttggacgaggtgatctgatgccgatcgccgtcgacatcgacgtgatgctggccaggcggaaaatgtccgtaggcgagctcgcggaccgcgtagggatcacgcccgccaacctggcggtactcaagaacggccgcgccaaggcggtgcgcttcgcgacgctcgccgcgctctgcgaggtgctcaagtgccagccgggcgacctgctgcgctgggaggccgaggacgccgcaggcggatgacgtgccccagggcgggcgtgaaaacgcctggcaccaccggcccgtgacacggcacgtaaaccgcgtgactcctcccctccctgaaggacggggctactcgctatgccgggttggcgtcgcgacggaccagcccggcccgtaagacgttgagagcacccaccgtgtcagcgtgcgcggtgtggccgcaggcgacgcagtggaacttctcctgtgcgggccggttccccttggcggtgtgcccgcattcggggcactctcgggaggtgttgcgggggttaacggcgatcacttcccgtccggcgctttcagccttggcgtgcaggatcgtcaggaacaccccccaaccggcatcgttgaccgacctgttgagcccggctttggcggcggccccgttgggcaggaaggcgcccgcccggccggggtcggactacggcgcgggggccttgctcatggtgcggatcttgaggtcttcgtgcgcgatgaagtcggcacttcgcactcagtacgatgcgccggtgatctcgcacagagctggcagtccggggcagctgctcgtcatcgcctgcacagtcgttgccctggtcactgcgccccttagttggtatgcagcacacaccgtgcgccccgactgcgtcgtcgccatctccaaagtcaccgacggcaacgggcaccatctccctgacgtgaacggccgagtgtggtcggacaatgaactcgccgatcgcgcctaccaacaggccgttgactcaggccgctgcgatccgccccatgcccgctggaggcagtggctcgactgactgtcctgccatgccgttcaggggcacaggacaaacgcgcagatcgggcaaccgcagctcgcgccgcagcgcccctggagcgcaaaggcagtgagggcagccgtggccgaggcgcggaccagctgaccacaacgcccaccgcgtatccgcctgagaatccgcggatacgaggctggagacggccgggaatacctgcgattcggcctcgggtacacccggtgggggcgggcttgtatctccgcaaggcaggcgggatcgcctgcaaggccatttgtgcccactggggccggggcgtcgtgcggcagggtgtcggcaacgttgcggcggtcgcctggcggtgatctcggcgcgaaggggtaggggaaatgcgacctgccccctcccccggagacgccgacgatgaccgacgacgcctatctcttcctgctggacgacccggccgtgccgctcggcgtgccgccgagcgtggccggtgagctgtcatgcatggacacccctgccgtgcgggcgtggctcgacgcgcagggtgtcacgacgacgtccccggcgctgcggatactgccgccggaacagaccgcggcgattccggagcaggcggaacggctgccggttccgctgagcgaggcggaactgagccgcttgcgtcaccacaacgcccctgaggccgtcgcccgcctcgaggaggagctcctggcctaccgcgactgcacggacggccgcgacaccctgctcaggcgggcccttgcggccggaattcccctggcgcgcatcgtggaactgacgggtgaggaaccggcggccgtggccgcctcctccgggtgaagacggtgcggggccgccagcactggcaggctccgcatttcggcctgaagtcctcgacggcgatggcgtcgtggtcggtcacgaccttcttcgcccacttgcggccggtgtcctgccgctgtcgggcgatcttcgcgtaggttttcgcccgccacttcttcgcctcgcggtagcccttcgaggcggcctgccccttcttcggccggcggcgggccctcatccggtcgtaacgggtcagcccagcctgcgccttgcggccgtgctgggcgtgcggcaggtcgtgggcgttggaggtggtggtcgcggtctccttcacgccccagtccacgccgagcacccggctggtctttggcagcggccgcacctcagtggggaccacgaacgagcagtaaccagtgtccgacgctgtcccggtacacgcgcgccgaggagggttcggccggcagggtgcgcgaccacaccaccctcagcacgatcccgcccgccaggtacaggcgaccgtccttcagccggaacccgcgccggtgtagttcagcgtcggcaaggccgcctcacgcttcttcttccccggcctgaaggccggggcatcctccggggtgccggtgaaggtgagggtgacgtctgccggcccgcccctgtgtcttgtgtgcggccgtcatgcctttggaagttggtgagccggtcgtggtcggcggcgtactggcgcgtctcagctgcggtgagtgttcagacggattttccgtcacccgcagcggcgcgtttcgtcggcagcccccggccgggcggagcccgagggcttcccccccccggcatccccgggctccgcccggcggcccgtaccacgctcccgccggcgtggtacgggccttatcctcaccgcccgggactccgcaggtcattgacgggcggcgcaggaactgttggcattccgcgcacggcatacggcggctgtccgtcaccggactcggcaggcgcggggggcgagcgcttcgatggcgggcggaggcgtcggacgcagcggccgtcgggcccggcgcggctgtccttgtcgcataacgtgcttccccaggccatttacggtgcacgaccatgcaggtggggcggaagctgtgcctcgctgtgtatctgcgggtggctgccaagacgggtgggaccacagggtgatgacgctttgtagccgggatgtgccggcagccgagcggttcagctggttctgcgagctggtggcccgcgacatggcaccgcacgacatcgtcaccgagcacgtccaggacttctccgcttcggcgacgctgttgtcgctgggtgaggggatcggtgtctccagcgttgcgttccctgccatgcagtcgatacgttcgcggcgcctcatccggcgttccgaccccgaactgtgggtactggccctggtcgtcaaaggggccatgcagcgggagcagggccgcaaccaggtgaatccgcgaccgggtgacctggtgctctacgactcctcccagccgtactgggcatcgatcgccaccgacgacgtggcccagtccatcgtgctgcatctgccccggcgcacggtgcccgttccggagcaggcgctgcgccggatggtggccactgcgctgccgtccaggacgggcatcggtgccctgctgagccagttgctcggtgggctcgtcgagcaggggccgaagctggaggccggtcagaccggccgggtggcgtctgccgtggtcgatctgaccaccgcgttcctggcagggctgagcggtgctgacggaccgcagaccacagcggcacggcgggtggcacaactgcaccagatcaagtcgttcatccggtcccggctcggtgagccggggctcacccccacggccgtcgccgcggcccaccacatctcgctgcgcgctttgcagtacctgttccgggaggacggcaggacggtcggcgcgttcatccgcgagcagcggctggagcgctgccgggccggtctcgccgacccccgtctggccgggcacagcgtcgccgcgatcgcggtccgtgccggtttctgtgatgctgccgcgttcagccgggctttcaaggcacgttacggaatgcccccgggcgagtaccgtcggcactgcggaggaccgccgtcgcaaggccgcgccgggcacactggctgaagcccgcttccgcctcgggtggttccgccctccccctaggaagggaggcaccagaggggcccgtcgccggccggcggcggggcacgacgccccgccggtacggccacgccagggtgtcggtgccagcccgccggccgcagcgggcccaacgtcttgcgcgccgaaggtcctccacgccgagggtctgtccgcggttcctgtcgcacggctggggcgcatccgcggccacctcaacatgccagtccgcgccggatgttcgtgctggagccccgttagggtccggcggtatgaccgaccgtgttctggaactcctgcgcacccgccccgatctggccgaactggccgcgttccccttcggcttcgatgtgagccgggcgtaccacgtcgaggccgtgcacctggcgtccggtgcgccgctggagccgatcgccggcgacgacaccggcggcacgtacttcctgtgcggggcaacggccgtgctccacgcgtcctccgagggcgacgccgtgctgctcgccgacagcgtcggcgaggcgctcgagatcctcgtccggctgccctggtggtgcgagaacatctccgcggagctggacgaggaggacctgctcgccgaagtacgtgcggcggaccacgcagcgcgcgaggagttcgcccccgaactggacgcgcagcgagcggcgttgatcagcggtctgggtctgccggaccggccgctggccgaactccttgccatgtcgcagtcggctgccgggcgcaccgagccggaccacgtcctgctcaactcccgtgagctctgcgcgtaccggctggaggagtccttccgccagcccctgcgcgacgttgtccttggcccgggacgggaggtgctggagcggatgcgccgcggcggtctgggcgcgcgggaggaggcggctggggatccggtgctgcgggcgggggtgctgcgggcggcgcagtacgaccgccgtgacggcgacctgccgctgctgcgtttgctgctggagcacgagagtgccgcgcggaccgagcggttcgaggagcggcggctggctgcggtgctggtggcgttgcacgggcgggagggggacgtttcgctgctgcggtcggccaccggggggcaggtcaccgacagcgccgaagccgtggagtgggcccgcgccgaggaggcgaagcggtacgggcgggatgtggctgcggagagcgagttcacctggatcgagctggcccgccggcagggtcgcatcgagcgcgcccgggtcgcgctcatccgcatgctggacgacacggggccggacgcggaccggctgcgggagctgagccgcgcgctggagcgcatcggcgactacgcgcaggcggcccgcgcccagttcaacctcctctcgcttcaggacactgcatgggaccgggcctcggaggcgtacgtcctggcccgtctggagcgccgcaggggtgacctcgtggcagcggggcgggcgctggagcgggcacgggcggcggtcggcgccgggggcaccacgccgggcggggcggattgccagtggcaccgccgggggctcggccggctgatcacggagcagcatctggagctgacgctcgccgcggccgaggcgggtgacgcggaactcgcgcgtgcgacgatggggcacggcaggctcctgctggacacggtcggcaaggagtcggcgaaggcgctcagccggctgtccacgcgggcgaaatgggcggtggccgggcttcgcccgcccggcgcctgacacccgcggcatcatcgcccatcaggacctggcgccgttgaaccgcgtggccggcagcaagggcggcgccggtggcgggccctcggtcatgccagcaccgtcctggccgtcctcgtccagtgcaggtatgacgcggcgcctgcaccgcggttggtcaggacctgaacctcctggagatcctcggcgtctccgcctgcttctccccgggccacgacggctcccccacccttcccttcgacccgcgcaccggggccctgcgcgagaacgagtggcagcgctggctggcctgggacccggtacggatggccaccacgcacgccgacgccctccgctcccagcgcggcatctggatcgacgcgggcacccgcgacgagtggttcctcgacctgggcgcactggccttccgcgatgcccttacggaagctggagtggccgacgacatcgtgcatttcgagctgttcgagggtggccaccacgccgtcgagtaccggatgccgcccgcccttgcctggttggcgcaccgcatcgccgatcggccttgacctcccgggttggatcacaccccgcgaacgaatcaataccgccgctcagcgcacaccccggcgagatccgccagaacgctctccgaaggatcaccgccgcggtgccggcccttgcggagcgcgccggggccgaggccggcccggtgcggcccggtgcggcccggtgcggctccaaaacgtgtgttcgaggacgtccaggtctcggtcctgacggggatgtccaccccgccggacggcacctcctgggcgtcggggcttcggaaggcgtcacgggagccggaccggttcatgccccattgagccgagcggcctgcgtacggcgggcgaagcgttgcgggtcacgggcgggggcggcgtgtggacgtgttcgtgtgaggccagtgcctgcgggtaagcgggctccaccaactcgtcagatccggcgtcgagccgaccatgaaatgaggtgccgtgtgtccgcatcactggtggagaccgtcgatatcgaagcccccgtcgccgtcacgtgggcactgtggagcgacgtgagccggtggccgtccttcctgagtcacgtgcgcctggtggagccactggacgagcggcgcttcgcctggcagctgtcgctgccgggagccgacaagaacttcgtcgccgagctgaccgaggtgatccccggggaccgcatcgcctggcagaccacggagggcgttcaccatgcgggcgttgtcaccttccaccggctcagcgacacgtcgagccgtgtgaccctgcagatcgagtacgacccgaagggtttcgtcgagcacatcggggcgctcaccaatttggactccacgctggcgaattacgacctcggcgagttccagaagctcgccgagacggcagccgccggctgacctcccggcatacgtgtcccccacgtgacggccttcagggccatgtcgggagaggccatccgcagccttcttgcggatggcctcttcccgtcagggccgggcggtggacgacattccgggatctgagggggcccaggcatcgttcgaggtcagatcataagaacaagctcagtaacgaccgagccaccaccgcgccgagagagcacggcacccgcccctccctgcccgtcctggaacttcaccggcagcccactgccggtgaagtggatccagcactcgggagagcacgccaacaccgccacggcaggatcatccgccgttcccaaagcagtgaacgagaacaggctgcgctgcaccacggtgcccggcgggaagcgttcgcggtggcatcacgcatttgggacgacttcttcgactgcctgcccgtgcgcggggacacactgttcgagctgacggacgcgttgctgtgtgcggacgggccggtgaccgcgctggtggacctgacgctgacggccgcgcatcggcgcgggcacggcgcgatgtacgacgctctcaactggtcttgaacggatgggtcatcgtcctcccggcccgtctgcccggttcggtgccgccacggccctccaaggcgcgggcaggcctgaatccgtcgctcaaggggcccggggatccccgggccgggacggcagcggtcacgcggcgcgctccttcaaagtcgctgcgacctggcggaccgcccccgacccttgaaggggcggggccgtatcgacatcgggtctcccgcgggcaggcggaggacgaagcacgcccccgaacccttcggctgcaccgccagcacgagcaggccgccgtgccgggccgccaggtcgcgggctatggcgagaccgaggccggtgccgccgtccgtacgggtgcgggactcgtccaggcgggtgaaccgctcaaatatccgttcgctgtcggcttccgcgacgccggccccgtcgtcgcggacggtgcacagcaccgacccgggtgcggccgagtcccgggccacagtcagcagcacgcggccgacggcgtggcgcagggcgttgtcgagcaggttccggaggatccgttcgaggtcaccgggtgccgcgaacaccgtcgtcgcggcatccggcgcggcgacgaggagatccaccttcggggaacccccggcgcgctccgcgtactcctccgagagccggcccgccagtgccgccacgtcgacccgttcggcgggggccggcggggcgcccgcgtccagccgggccagcaggagcagttcctccgtcagaccgctcagccgccgcgcctgccggccggccgcggacaccacggcgggccagtcggcccggtcggggtaggcggtggccacctccagccccgcgagcagggtggcgagcgggctgcgcagttcgtgcgcggcgtccgccacgaaccggcgctgtgccgtggccgcctcctccaaccgctggagggtggcgttgatggtcagcgccagttccgccacctcgtcggcggtgtcgggtacctccacccgttcgcgggggtccgccgcggtcaccgaggcggtgcgcgccctgatcgcctcgaccggccgcagcgcccgccgcgtggccagccaggccaccccggccaccagcgcggtcgcgaggggaacggccacgacgagttcccggtcgagttcgccgaccgcccgctcggcatcgtccgggacgatcaggacgtacacccggacccgggcgccggcggccactccgcgcccctgcgtctcgccgggcaggtaggaggcgggcaccgtcccctcgacggtggtcagggtctgtccggacagcgagcgggccgccggctcggccacggcggggaacgtgaaccggcgtctggtgtacaggggcaggctcccgccccggcccgggcccgtgaggaacgcgtggccgtccttctcgtacggctccagctcgggactggacgccaggagcatgccgtcgccggcgacgatttcgtacggtgctccccaggggccgctgatggatgagttggcggtggcgctgagaagggtggtgacctgctgctgggccaccgacgaagtggcccgcagccgctcgtcgtacagctgatgccgcatcagcagggccccggaggtgaagagcacggccgcggcgaaggcggcggcgagcgcggaacgcgcccgcaccgagcgggggagaacccgcagcgagcgaagaacccgtaccgagcgtgggagtaggcgggcgcgctgaagccggcggagcatgccgggcggggacgcgggtaccagggcgcggcgcccgttcggatcccggccgttcggatcccggccgttcgggacgtcagtcaccggagttccgtccggcaccgtcccaccgcccggccgggggctcctgaacggcgtcttcctccgtctccccgcggtcgtcgaccaaccggtagcccaccccgcgcaccgtcaggagggactgccgtccgaaggccgtgtcgatcttccggcgcagggcgctgacccggacttcgaccaggttgaggtcctcggcctcgtccggccaggcgtggtgcaggatctccgacttcgtgaccgcttcgcccggccgccgcgcgagcacctcggcgactgcgaactcccggggcgtgagcggtacggcgacgcccgacctgaggcaggttctggccgccacgtccaggaccaggtcgcccaccgccagcagcggggaggccgctccccgcgcccggcgcatgagcgcgcgcagccgtgcgaccaggaccaggtaggtgaacggcttggtgacgtagtcgtcggcgccggtgtcgagggcctcggcctggtcccagtcgccgtccttcgcggtgagcaccagcacgggggtggtgatgccctcgcggcgcagctgggcgcagacccggtagccgttgagcagcggcagcatcaggtcgagcacgacgaccgcgtagtcacccgtgcgggccttccacaggccctcgcggccgtcatgggccacgtccacgcgatagccctcggccgtcagcccgaggcgcagcgtctgcgccagttcgcgctcgtcctccaccaccagaatcctcaccccgccagcctggcacaggcttccggcggctccctgaccgcttcgtcaggttcggtcagggcccggtcagcggctctccggcacggtgtccgggccccggaagggtgcttggcgcgccggcccaccgcgcggcgagcgccgcaccggtgatccgccggacgaaaggccccgacatgccgacccgcctgaccgcgctcctctccccgtcccgcccgtcccgcccgtcccgcgacgacgcggccgggcccgtcgccggaacggcccggccagcgcggggcgccggctgggcgaccgcgctgtcgctcgccctggtgtgcttcgtgacgtatgcggcgctgtccgtgcggctgcaccagcggatgctgaccaccggctacgacctggggatcttcgagcaggcggtacggtcctacgcgcacgggcacctgccggtggccgagctcaagggaccggggttcccgctgctcggcgaccacttctcgcccgtgctggccctgctggcaccgctgtaccgggtctggccggcgccggtgaccctgctggtggcgcaggccgcgttgttcgcggtggcggtgatacccctggccaggtgggccgaggaggtacgcggccggcgggcggcgctggtggtcggtctcggctacggcgcctcctggggggtcgcacaggcggtcgggttcgacttccacgaggtgtgcttcgcggtgccgttgctggcgttgtccctgacggcggtgggccgtggccgggcgcgtgccgcggccctgtgggcgcttccgctgctgctggtgaaggaggatctcgggctgaccgtcgcggtcgtgggtctgctgatcgcgcgcaccggcgagcgcgacgaccgcaggagggggggtgccctggtcctggccggagtgctcgggtccttcctggagatgctggtcgtgataccggcgttcaaccccggcggcacgttcgcgtacagctccagcgtgcccggcgcggggtccgccaccccgggcgccggcgagttgctcctccactacacggtgggactggtcaccccggacaccaaggcgcagacggtgctggccctgctgtccgtgaccgggttcctggccgtgcgctccccgctcctgtgggcggccctgccgacgctcctgtggcgcttcgcgtcggacaaccaggcctactggggaaccggctaccactacagcgcggtcctgatgccggtgctgttcgccgccttcgtcgacgcgctgacccggcccggaccggtgcggtacgcgctggcggcgagcgcggccgtcacggtgctcctgctgccccagttcccgctgtggcagctgacgcagcccgccacctggcacaccgactcccggctcgcgtccgcccggcggctgatggaccgcatcccggacggcgccaccgtcgccgcctccaaccggctggtcccgcagctcaccaaccgcgcccgggtcagcgtgttcggcctggggggcagccgtcccgacgcggagtggatcatcgacgacagcgcgcagccgcagggctggccgattgcacccgacgacgaccgcaggctgctgtccgaggtccggaacaacggccgctaccggaccgtcgcggaccaggacggctacgttctcctgcagcggcggccctgacagagccgcaggccggcgacgccgtggagctcgtggcgcctcctacgcctgtcctacgcctgcgcccgcccctgttcccgtacctgggcgagccgttggacgccgaggccgagggccgtccggtggcgtccgccgggaaggtgccgggggcgccggcggtgaggacgatcgcggagcagcccggcagcccgctgggctcatgacgcgttctccggccacagtccccaccccggggctgcggcggtgcccgggcttcgctcgaagatcacctcttgccgggccgttcaccgactgtacgtagctgagacgcggcgtgtgctgggctcccacggcccaacacacgccgggatggacagagttggtgccgtataccgtggcctcgtcacctgtcgtccgaggagttcacctgtgccagatgagacagacgagtcagaagagaccatgctcacccacattccgccagacggggtcgccccggggaacggctacagccatgtggttgtgggcgaaggccgactggtcgtcatctccgggcaggtcgcactggacgaaaagggaaatgtggtcgggaaaggcgacgccgccgcccaggcccgtcaggtcttcgagaacctgcggcgctgcctcgcggcaggcggcgcaacgttcgccgagatcgccaagttcaccttctacgtcaccgacgtcgccatactgccggaggtacgggccgtccgcgacgcgcacatcgacaccgcgcgtccgcctgccagtaccgcagtacaggtcgccgccctgtaccggccggagctcatgctggaggtagaagccctcgccatcatcccctggtgactcggcaagcctgtggccgggcggtgggacgggttgctcatgaccttcgagtgaacccgccgcggcccgggcatcaccgcagctcagggattgcggcgagcggcatcacgcgaagaatctcagcaggatcaccgatggacgggggcgggctcgctttgtgaacgcgcggttcgaacggacggcggccggctgccgccaggccctcagcctcaccgcccggaccctcactgccccgccgcgcagccgcgttctcccggcccaaagagcagacgtccggccggggaagggaattcaccagcttctgagcaggatccaccgggcttcatcaggccggccgggcaccggcaaccgtccgctcctgtcctggcgttgtacggagtccggcggcggcgcgcgggcagacgcagccggccgggcggcctgaccgtcacccctcaggcgcggagatcttgggcgctgggcgccaccgggccgagaaggccgcaattgccgcccggactgaaggccgggatcccttgcgaagaacaagggatgggagtgctctgtgcggtgaggggcgagggcgccgccgggcgggtcggcctcaccccctcgcagggcgccggcacgcgccgtcgcggcccacgacgccgggaggtcccatgccccaggacatcgacttcggcctccccgcgcccgcggggatcagccccggcctcgaggccacacgccggcacaacctcggctgggtgcgccgtctgggtttggtcggcgacggaccgtccctcgcctggtacacctcctgggacatgccgcgtctggccgcctgcggcttcccccacgcccggggcgccgcgttggacctgtgcgcggatgcgatggcgttcttcttcgtcttcgacgaccagttcgacggccctctcggccgggatccggcccgggctgcccgcgtctgccggcggctgaccggcatcgttcacggcgccggcccagggcctggagcggacgcgtgctcggcggcgttcgccgacgtgtgggcccgcagcaccgacggcgcccacccgggctgggtggcgcgtaccgcgcacgagtgggagtactacttcgccgcccaggcccacgaggcgatcaaccggctccgcggcacccccggcgacatggagtcctaccttcaggtccgccggggcatcgccggcaccgatctgcctctctccctgggcgagagagccgccgggatcaccgtcccggcggccgcgttccacagcccgcagctgcggatcatgcgggaagcggccatcgacgtcaccttgatgtgcaacgacgtgtactccctcgaaaaggaggaagcacgcggtgacatggacaacctcgtcctcgtcatcgaacacgcccggcgctgcacccgcgacgaagccgtcaccgcggcccgcggggaagtcgcccggcgtgtcatccggttcgagcagctggcccgggaggtacccgccctgtgcgcccagctcgggctgagcgccgtggagcgggcccacgtcgacacctacctgggtgtcatggaggcctggatgagcggataccacgcctggcagacccagacacggcgctacaccggcgcgccacacgtcctgcccagcaccggccccgggtacttcgacgaggtcctgcccacgtgaagtgctctccgggccgcccgccggccgtcgtggtcacccggggcgcccactgtccgccggtcggcaggcgggtgcgcccgctcagggtcaccggggccggtatgcggtggccagcacggagacggtgacctggtcgggcaggaggccgtttccggccaggtctgcacggttcaggtggcgtgcgctgggcgtcatccccaccaggtcgagggcctgcgtcctggtcaagaacgtggcgtactcgacctgttcggtacgggaggtctcgaagaagggggtcagagccgtgaacaggcgctgttccttggccgggtcgatcgtgaccagcgcggggacctggccgcgcagttcggccaggtgccgtccggtagggcgcaccacgaccagccggccggtcgggcgcagcacccggtggaactcggatgggttgcggggggcgaacacgtccagcacgacgtcggccagctggtcggccagcgggaagggacggacccaggtcaccgctgcggctcgctcatgggctcgggcggtggagcgcagcgcgcgcaccgaggtgtccaggcccagaccacgggcgccgggcaactggtcgaggacgccggctagatgaatgagtccaaggggtgttgttgcggtcagtgaccgtaggctgtgagtgatcgtttgatgggctgtccagtttggtcgttgtgccagatcgccgctgtgagtgcgaggatccggcacaagacccgggctgacactcctgcagggctcttgccgccgtgtcgttccaggttgagctgccccttgaaggtctgattgatcgactcgatgacctgccgcagcggtttgaacaggtgtgacccggtcagctcggcttcccccttgcgggctggccgcagcaacttcaggtgacgctcggcaaggccgcgctcgaactcgcggccgaagtagttcttgtccccgatgatcgtctgcccggggtgagcggcgaggacgtctggcgcggtatcgagcatgtcgcgcagtgtttcgcgctcgtccgccccggtgagtgcgaacaggaccggcagtccgccgagtgtgcacaccaggtgcagacgcagcccccagaagtatcgcgagtgtgatgcgcagtagccgtactgggcccagcctgccagtctcacgggagcaaccgcagccgaccggtgtggagtcgaccagccacacatcgtcgctccacagtgaggtatcgcgggccacgatccggatcatgctggtgagcagtgagaacgcggcgcgcagccgcttgttgtagccggactgctggggcacgtagggaaacaggtggccgaagtcccgcccgacgcggcgaagccagcgccgctcagaggtgtatccgagcagcgccgacatgaccgcgagcgtgatcagctcggcgtcactgagtgtgggcgtgattccgatggcaggccgccacggcgccagccacggtgaagccttcaactcgtcgtcaatccgggcatagagtgccgttgcgagggtgtccaggttgttagtcacacatcgacgttggacgccctcgcctcatgtccgcaggtgatcctctggactcattcagggatccggggcgtgcccactgcggtgactatgcgtcacggctatttcgcagggcctggatgagccaggggtacaccgggatcaggttcggtactacgtgccagccgttgacgatccataccagctgccagtatcggtctacccggggatcgtgcgtctcttcgaactgctgggccatccagtcccggaattccgtgtcaggggtgcgcgcgagcacctcggcgaagcggtgcacgaggtcgtcgatgacgggtgcgcccctgtcgttgagcgggtcgatgcccgcctccatggcctcggccaccttctgacgggtgaactccatcagttcctcgccggcatcgcattcgatgtcgagcgggcgcccggccgcctgacgtacggccgtccggcgcatccgggcacggaaatcctcgtcgccgaccagctcggcgagctccacccacgcggtgacctgctcgccggtcggatcatcggggaggtcgggagtggcagcgcgaaccatggccaccgcggctgggtcggcatccactgtgccgaaggtgccatccatgaaatcgtcgatcagacggcggcgttcctcgccggacaactgcgtgagcctgtgcatgagcttggtctcctcgggactggacccgcggctggccacgactcgcagaacgctccgacgcagttgcagcgtccggatctggacgtccatggcgtcggcgtgcgccgcggcgacttccgccaccgagagctcacggtccagtacccgttgaatcgtgggcaggtccatgcccagctcgcgcagtgtgcgcaggagttccagacggagcagtgcgtcgaggtcgtagagccggtaaccggcgggactacgggtggtcggcgctaccacccccgaatcggagtagaaccggatggtcctcacagacaagccggtccgccgggaaagctccccgatcgagtagagggtcgtaacgtccatgtcccccactctgctgtctccagtcagtggagactcaaggccattccccagccgggccccgacccagacgtccaccgagtcgctgaagcatgcgtcgcgtgctctccgctgaccgccaaaatgaaacgggcacgccttgcacgtgctgggcgggcgatggcagcgacatgcgacgccactcgctggcggcctacgactacgagcccttggactcaatcatctaggtagtagcccgtgccgcaccccacgtccaggaccgtgccctgctcgggcatcgcgtcggccgccaggcgggccacggcttggcggatgggcccgtagctgccggtggacaggaaccggtcccgggcccgggccatggccgcatcgtcgccgctggtggcgcgggtgcccgtcagaaggctgacgtagccgtggcgggcgatatcgaaggtgtggccggccgggcagcgcagtgcgccgtggccgaggtggagaccggtgcggcacgttgggcagcgcaggaggtcgaggaacggttcgagggcaggggacagcgacacgggcacaaggcactcctggcaacggtgaaagggagaggtctgtgcctgcacgtgttcagaaaaacgccgtcccaagggggaacgggcccggcatccggccgcctcggtaacgggcagctccgggaacgtaagttcacgcagcaggcacaccaaggagggcgacgccgtccggcatcgccctcggcctcccggtcagaggaagcagtagtgcggggtgctcgtgaacgtcacaccgcgattctacgatttcagcgcactgggaagccgaaggaatatccctgctgcttcagccacggcaggagctcgcgcagggcggccacggtctgggagcggtccccgccggcgtcgtggaagagaatggtcgggccgtggggtatctcgttcttgacggtggcgctgatggcgtcggcgccggggcgctcgaagtccttggagtcggcgttccagcccagcggccgcatcccccgggaggccgcgaggtgccggctgtagggggtgaaggcaccgcccggggccctgtagtacagcggccggacgcctccggaggctttggtgatcatgcgttcggcgtccaggatctgtcgtgactggtacgagtgggacttggtgtccatggtggtgtcgtgcgagaccgtgtggtcacacagccggtgcccggccgccaccaccgccttgaccaggtccgggtgagcctgggcctgtgtgcccaccatgcagaaggtggccttcacgccgttctcccgcagcacttgcagcacctgcggtgtccagatggggtccggtccgtcgtcgatggtgatgttgacgccttgggcgccgtggtccgaggcgtgggcgatgtccgccgacaccggcgcccggccggtgccggaacccggtgcggcggggcgcgcggagtgctgcccgtcgacgggaccggcctgtgcggtccataccgaggtagcggctgccagcgccgtcaccccgaccgccgccgcaagtacccggccgtaccatccccgcccgccatgccgcgccatgtcagccctgttccttgtcgtcgtggtggattccgtgcacccgtcaggacggagaaacggccccgcgagatccctctgttgctgatcacggacaattccgcaggggtttcgagacgcgtgagcgtccgcgtcgggagccggtgagttcgttgaccagcggtatcgggccggcggtgcctgtccggacggacgcgtacgccatcaactcgcggcccccgccgcgtgtttcacctggccggtgggctccaccggcaacatcgaccagaccttcagcgtcgacggctcgctgctccagtcggaaatcgttgcctgagctggccggcttcgttgttccgggcatggcaaagtggccgaagccggttggtgggactgggagttggagtcggtgttcgcacgggttgcgggccggttcgcggggtggatctgcggtggcggacgcgggaccaggcgcgcggtctgcggtcgggtgcggtccgtccgactcgcctgcgccaggcggtagttcacaccgcttcgcgcaggtcatcggattcctcgggtgggtcaggaggcggtgggccagctgcgcagcagggcgtcgagtgcgttgaggatctcggtccagctctccttggagtcgggggcgctgtggctgaagccgccggcgctctccaggccgacgtagccgctgaagacactgcccagcagccgcaccgcgtgtgtctggtgcggttcggccaggtggtagccgcgcaggatcgcccgcgtcatctgggcgtgccggacgccggcgctggcggccgccgtctgcgggtcgagccggaactgggctgcggcgaagcgtcccgggtggatgagggcgtagtcgcggtaggcgttcgcgaaggcggtcagggcgtctttgccggcccgtcctgccaccgcggtggagacctggtcggcgagttcctccagggcgagcagggcgatcttggtcttgaggtcgtgggcgttcttcacgtgcgagtacaggctcgcggtcttgacgccgaaccgccgggcgagttccgcgggggtcgcctgctcgaagccgatctcgtcggcgagttctgctcctgcccggaccaggcgctccgtggtcagtcctacccgtccggtccctgccatgctcatcctccgaattgcttcccatctctggcatcgacgattatgcacttgcctaatcgaattaggtctgcgccaagggatggggccaggcgtctggccgtcccccgtgaccggccgggcagtgcctcggcggtctggacttcctgggcaggtgagatccccgggcctggcctttgaccgggcctgcctttgaccgggcctgcctgtgaccgagccggacggccgcccggccggtgtccggctgtgctcctccggcggcggcgccggcgccgggcagatgtgccgcagcaggtgctcggtgtgcgtggccaccggcaccgggggcgtctgcctgacggccgcggcgaggtccgggaaggccgggcagcagggcagctcggccggcatctgcatgggcatcgatctggcctgcctgctcctgtaggcacgcgggaaggaggacgcgggcaccggcgcacgcctgcgcacgagtccctcaccctggaggagaaggtccagccggccgtggcggacctcgccgcgtcatcgcccaggtgaccgcggccgggggccgcctcccgctccagcccccctccccccggtatcgcggtcagcgacacctttctgccgtcaggtgtcggttcagccggttttgctgaacagccggggccggctctgcacgacgtccttgacgaacacgatgccgtcgctgtccgccaggtgggccgggtcgagcggggcgtagccgaaccagggggatacgcggggcgcgggccgcgtgtcgccgagggcggtggccagccgcggggcgtcgatgacgcagcggtcctgcgggagcgcgtacaggagtccttcgacggtgtccggcggcggggtgtccactttctggtggcggatcgtgccgagggcggtggccacgaaggcatactcctcgccgagccgggcgctcaccagcgcaccggcgctccaccactccagcggtatcccgcccatgcgcatcgtgctcttggcccgctggagatgggagttgtgggcgtggatgagtgccgggccccgggcggcgagggcgaggaggttgtgggccatcatctggtcccgcaggcccaccagccgggtcatgcgggccggtgaggtgtcggccatccagtagtggtagcgcagcaggccggtcgcggtgcgcccgtacaggcgtgcccggtcccagtcgtcccgcgaggtcgccgtggtcaggtgcggcgtctgtgcgtcgagcagcgccaccagatcgtcggcgagcagccgcagccggccggcctcggccgactgccccgcggactgggccgggtccgtcatcgcggcgggatgggtccaccggtcgtcggtgccgagcaggtggtcgagtgtggttgcggtgcaggggagcaggtttgtgtccacccgggtcgcgaggtagctgtggagtgcggtgagggcctgccgggggctcgcggcgtgggtgatctccagcgggccgtcgaagccggcgaagcggagccgctcgcaggcgggccggccgtcgttggcggcacggacattgtaggcgcgcatccagcgcacgagttcgcggttggccgcaaaggtgccccagccgtggctgaatccgtgttccatggcctcgtcgagagtgccggtgcccgaggtgacgtagtcgtccacggccaggcccgtcaggcagtcgctctcgatcgcgatcgtccggtagccctcctgctcgacgagctgccggaagagttcgttgcgcaggccgaggagagtgtcctcgccgtgggtgggctcgcccagggcgagcagccggggccgggccgggagcagcctcatgacggcggcggcctcaacagcatgggcggtgtccttgatgccagtagccatgccttcgacggtatcgttgaagcttcggttgaaacttttccgcgatatcggcaggttcatggggcgaaaccttcaaagcggtgagcggctcaggccggttgatctggcgcgtgggcacggtctgtccacgcaggcggtcaggaattacgaggaggccggcatccttccggccgccggccgcacaccccacggctaccgcacctatacctcgctgcacgcgggggccctgcgcgcgtttcttgcgctggtgcccggccacggccaccggacggcggcgtcgatcatgcgggcggtgaacgagggcgcggtcgatgaggcgttgcgcctcatcgacgagagccacgcccagctcctcgacgaccggcggaccctccaggccgtggagagcgccctgcgcgacctggagcccaccacggggtccgggcccggtggggggtccgggccggccgcggggtccgggtccgggtccggcggcacgttcatcgggccgctggcacacaagctcgggatccggcccgcgacgctgcgcacatgggaacgcgccgggctggtgcgcccgcgccgcgacccgctgacggggtaccgcgtctacgacgaggccgacgtacgggacgcccggctggcccaccagctcaggcggggcggctacctgctggagcagatcgccccgctgatcgcccgggtgcgggcggccggcggcctggagccgctggaggccgccctgcgcgactggcacggccggctgtccgcccgcgggcgggcgctgctggccggggccgccgggctggaggcgtacctccacgagcgcaggaaaaccaggtcctgacctgcgtcttcaaggttgaaaaacacctgctcggcttgttcttggccttccggtgctgaacggtgcctcgcctccaggtgtcctggctccaggtgaagccctaggcccgcgcgggcagccagccgcgctggacggcccgtacgcccgcctcgaagcggctgcgggcctccaggcgttccatgagttcggaggcgatgcggcgggccgtgcggggcgagacgcccaggcgcttggcgatcgtctcgtcggtgtggccctcggcgaggaggcgtacgacggtggcctgctggccggtgagaccgtgccggtccacggggacggtgtcccccagcggctgcgcgccagcccacgtcgtctcgaacagggcgtgcagcgcggtcagcgtgccctgtccggtgaggaccaccgctccggccgcggtgtcgtcgctgctgaccgagatcagcgcggtcttgcggtccatgaggatcagccgggtgggcagggcgggcacggtgcgcacctggccgcccagggacgtgagccatctggcgtgttcgacggtggcccggtcggtgcgcacgctgtcgaggtagagcgtgcgcatgcgcaccccgcggccgaggaggtccccgttgagcggccgggacgcggccatgttgtccgcggtctgcgggccgcccggggcgaaggtgagcagctcctcgctcacctcgcgcgtgagaccggtgagccggtcgcgtatctggtccaggcccaccagttgttccacctcggggtggcgggtggccgggcgcagctcggagtactcggagatcagctgggccgcggctgcccgcgaggcctccacgcgctgctgctgcgcggcgagttcggcctgctggcgtgccatcaggatctccatgccgatgtcgggcgagaccgcgcgcagccgccccgcgtcctcggcggacatccgcacgagcgccagttcgctcagcatgtcgagtgcgtcgcgtacgtccccctccggtacctccaggtgtacggcgagttcggcgacgcccgcctgcggatgcatcagcatcgtgcggtagaccgtctcagcggccgtgtccagacccagtgtggtcagcattggtaaccccccagttcccatggcttttgccaaaaagcgaaacgatctttccagactgttgccggttacgacagacggtggacggaacaggccacggacggaacaggccaaagcggacggccgtggtgggtgcccgtgtgctgggacggtagaggcatgtacctcgtccacatccatctggagtttccgccccggacccaactccccttcggagcacgggacatgatccgggcggccctcacggcggacgacctcgtcgagcacgtggccgtgcatccccggtcgccgtcccggctcaccctcggcttctatctgctcgccgcccgcctggaggaggcggaggagagagccgcacgggtgagccgccggctggcggaagacgttcccgtcctgcgcggggcccggctgcgcggcgcgggggtcccgctcgtgccgctggcgttcgagcggacgccgggctgatcaagccggtggactgatcgggccgccggacagggccgggccgggagggccgccggggccgggagggcggccggtcgggcccgggtcgtggccgtggccgtggccgccggccggggccggtgtggacgcatccgtccaaggccccttccgtccaccggccaccccttcccgcccgcctgacctgcggcgaagctatgaatcaccggccgggacacgcaccaccgcggggtgtgggaacgggccggagccgcctcatagttgacgccggaaggacccgaacagtcatgagccgcactcgtatcgcccaggccgccgcggtcgccaccctcgccctcgcggccaccctcgccgctccggccttcgcgtccgagtccgcaacggcccgggtctttgccgccggcgacgcgggctggcaggtcgcccccgccgacgccggctggcagtgagcggccccccgcacccgcctgtggccctgctgctccccgtgagcggcagggccacaggcgggtgcggccctcctgggcgcggcccctgaccttggaccggacaagggccgtcacattctccgcgctccggcgccggctctcccccacggcgggccccgcgacgccaagcgggctcgggggcagggaaacaagaccgcctggcccatgggccagggccagttcgggccggtgcggcatccggcggcactgccggtgcagtcgcgccaccgaacgcgccaactggtgacgcccctgccgcccaggcatgcggcatccggcgcggccgtccaggaggcgccgcacggccgccgcggaaccctgtcggcctcttcccgcgttcccagtgagatgaccttcacccccgccgcgccttcgggctactgtgcggccggacggagttgaggcctgtgccgccgggcgtcgtttcgacggtcccggcgccgccgcaccggttcgcctgctcgaggacacctccggttcggtgccgggtcggcaaggggggcaagcgcgcagcccggaggcgagggccagcagccttcggggcgggtgacggatgagggggcgggtacgtttccctgcggcgcagcagccgcccctcatggagttcggccggcgggcgtgtgtcgccgatgccgggttcggggatccagtccggtgacactccccggtccctctcaccccggcacgacacctgatgccgcatcgcccgccgggcggcactcggcacgggcctgacggcaggcgtgtcgcaccccgttgccggcagggctgcgccgaggtaccgggcggtgtcactggccgccggcggcgtggcgtggtgggcgccgcagaacccggttgccggtgcagcggccgacgtctgggtcgcccccgcgggcagagcagcgagcggcgccctgccccagtagaggttatctgcgcccccgacactccgaaatctatgtccgccggagtagacattgtgcggtggcgtggttatggtttctctcgtagccaagggagagcaagcccggcagagatgaactgccaggcggtagtaccgcagttcgcaggacggtgcggtggtggagttccgaagccagggcttttgcaggacggtgacgggactgacgaccggaccgggtggcccgcagtattcaggggccgccgttcagcagtgcagtggtgagtggcttctcggtgaaggcgtcgggctgcgggcgcgcgtgccgggaggttcggcggcggggttctgggccggagcggttcaggtcggttccaacgaggccggctgccggacagagtggcgctttccggggccaccagtagttcgcatcaccaggagtacccgcagtacagcagtaagagcggtatcagcagttcgcagtaccggttttggcaagtgatgggttcagagggaagaacggaggagttgagcgccatcaggatcgcccgggcgtacgacgtgagcccgggtaccgcaggacatcgataggtaggtggtctccggtcacgcatccgcgatccccgcatcccgcccgcgtatcgggcggccgtgcggacttcagtaggccggcgcagcactgaggccggcagatggtgtagcagttccttcggggccctggtgccgtacagcaccagggcccctccacgcgttccaagaagaggcacctggccgccgaggcggggatcgccgtcgtcaccgtcccgccccggaatacctcccggcactgcccccgttgcctgagcccgctgcggcaacgggggcagtgccgggctggaagtgggccttgtgtcccgaccgggccggatgcggttggcagggcgaccgcgaccacggcacctggcagcgcatcgccgcacgcggcctcacgcatcaggcgtcccgcgcagagccgcgcggtcatccgccggtaggcggcctggataccgccgacgccgcggcgggcgaggagggagcagcggggccacgcgatcccaccggtcatcagacacaagatcatccggcacctgcagaactctgccgcccgctagcccaactgccaagcccctgaaccagaattcattctgaaatgatcagtaagggaggccttccccgtggggtgcctgcggccggcggtccgcgcccatgcgacgagcccgttctcgcgagccgaccggagccgaatgcgagcggcagattccgggagccgcgcacacgtgggaaccgtgcgcagtgggcagagcgcaggggcgggcccgatcagttggccgacgtgttccgtgtcatctcggctgcctcggtgatggcgcgttgtctgagatcgccgaacagctgcatcgtgacggcggccaggacgtcgtccccgccaacagtccgcccgtccccgcggcgggtggacagggcgaggagggggtccttgagcagcggggccggggctggctcgcccggcaccaccagactgaccgtcccgaaccgcttgaccccgccctcgcggacgaccttggccgcgtcccgggccagggccgtcaggaacacgctcacgattccgtccaggtcgcggaccatcgccgggaccgccctcaccccccggcttgccagcagccttctcaccccggcctcgaaccggtgggcgccagccacaccactcggtgtacgcgccccgcggcgctcacgaagagacacgagcgcaccatcggcgttgcgcacctcgcccatcaggccgtggaaggtcgggctgtgcaggtaccacgccgatcccacctccacctcgacgttccggtcgatcgccgagatgaggtccttgggaatcagcctcttcctggcctcctcggccgccgcgcttctcgcgccgtcgatgatctccgtcagcacggtccgcgtcaccgacgcggcggcccacgcggccggccgggagacgtgcaacgaggtcacgtccctgaacaccgctttgacgagctgaggcttgaacggcaggtcggtcacgagggaagcggtctgcggaccgctgcgctcggtgcgtaggggttgtgtggtcatcgaagaatgtgctttctgctgtcggaggtgtcagtggcccatgccgcaccaggcggcgagaccacagagctctgcggagggcgccgagccggcacagggcctgccgggcggggcccgctggcacacagaggtgcaggcggccccgcccggattctcggcgttccggcgaccgtgcgtgcggcaggaggtgccacccgggcgacgcgctgtggtgcggcgccgtgccggtcaggcgacctggtacctgccgacttccaggaagtggcgcagtgcttcgggtgtgttgtcgtcgagggcggcgttggctgccgcgcgcagggccgggctgatggacgggtcggcgaggatgcgggcgatggcgacgcggtcgtcctcggcctgggcgatgcggtagccggtctccagccaggcgcggatcgcgtcggagtcgttggcgtctaggagggcgttgacctcggcgatgacgcgccggccgctgtcggggtcggcgagcaggcgcgtgatggcgacgcggtcgtcctcggcctgggcgatgcggtagccggtctccagccaggcgcgcatggcctcggggtcgttggcgtccaggagggcgttggcttctcgtgtcacacgctggccgctgtccgggtcggcgaggatccggactatggccaccctcaggtcgtcggcgtccggctcgttggcggacgaggacaccgcgggcaccgtcaccgcggtcggtgccgccgtggcggcgaaggacggggtggcgagcaggagggccggggcgaggatgcccgcggcgatgccgggcgctacgcgatgcagtcgcaaggggaatgctcctcttcgtttgctacggaggtgagttgaggacgcctcagggcgttcacttcggtgatgctgccacctgggtctgacagtggcagttgccccgctgcggtcgcagggcaccgtcgccgcggacgtggccggtgtttcatggcggcgcgccttcgagaagggcggccttgagcgcggctcgtggctgtcggggcatgatcgggcgagacgattcctgggggcggtcgtggtgtggtccgagcgtgtggtggggcgcgacggggttcggcttgtctgccgggaccggggcgggccgggggagccggtcgtgctgctgcacggcttggccggtcatgcgggtgagtgggaggtggtggcctcgcggctgattgcccggtatcgggtcgtcgcggtcgatcagcgcgggcacggcgcgagcgagcgtcatccgtacgcgccgacatccacctcagcctgctccaactcgcctgcagcatcatctgcttgagacgactccgaacttcattctgaaacgatcagtaagctgatcagagacgctcccctgtgcgccgctctcggctgggaaccggccgtgctggaagccgcgcagggcgcaccggcctcgtccgggcgccgcacgcgccgcccggggctctccgaagaggtgctgcgggcctatgcctacgcgtgcgctttttgcggatacgacggcatgctcggccgtaaccccgtcggcctggaagcggcacacatacggtggcacagccaggacggccccgacaccctcgccaacgcactcgccctgtgcgcgctgcaccacatcctcttcggcctcggggtcctcggcctctcccccggcctgcgcatccaggtctctcccctgtatgtcgcccgcagccacgccggacacgccgtcggcatcctccaccgccggcccctcgccccgccccgccccggccaccccagccccggcccggaacacattcactggcatcaccagcaggtcttcaagcacgcccccacgcccgtggcgcggtgagcgggcccccggcagcctgacacggtgccagatccccgagcctggccggcgcatcgtcaaagatgcttgcgcccatgcccgtcgccggcgccgctcccccaccccgccacccgtacccgctggttcgggccggccggcggcgggcttctggcggctttgccttctctttacaacctgttctgctgctgcctcgtctctgtgcccgatccgtaattcagcccgccgcatcaccgggcgggccgaccgacgaaagagagcgattcatgcgccgaactgtcctcagcgccgcggcacttgcgtgcacggccgtgctggcgagcacggcggtcgcgttcgccgacggggcgagcccggcttcctcgacccgtccggccgccaccaccgccccgaccccggcggcgagcgccgcaccgacccgggcggcgaccccgagcgccgtgccgacgcgggcgtcgactccgagcgccgcaccgacgcgggcgtcgaccccgggccaggtcgccgtcgtaccgaagggagcgcccgacaccggtgtgacgccggcgtcggcgcagtccgaaactgggggcgggctgatcggcgggggtgctgccgcggtggccgccgtgggcggcgcggcggtctttctcgtgcgtcgccggcgggcgagcggggcatgaccctgccctccaggcgcgccttcaccgccgcggcgatggcctcgttgctcgtgggctgcgccggccccggggccggccaggccacgacggccgcacgccctgggcgtacgccctcgtcttcgcgggccgccgcgaagccggcgcatgcgcttgggcgttcggtccccgtcgggttgcagatcccggcgatcggggtcgacaccccgctcctgcggctggggctggccgcggacggcagcgtgcaggtgccgccggtcacggcgcacgaccgggcgggctggtaccggcactcgccgacgccggggcagaggggcccgtcggtgatcctcggccatgtcacggtcggcgcttacggggacggggttttccgtcacctcgcgcggctgcgccggggcgagcggatcgtggcgcgcctggagaacggcacggcggcggtgttcgccgtcaccgccgtacggacggttcccaaggccgacttcccggcggacgcggtgtacggggacgtaaaccgtccggagctgcggctcatcacgtgcggcggcccccgcaacggtgacgggtacctcgacaacgtgatcgtcttcgccgcgctgagctccgcaagcccctgacccccgccgcccggatcccgggccggcggacccacgtgtgccggcggcccgggatccttccctatgagtgccatcacgaccatggagagcgttgaaacggtcccgcgagagggcagcgtccgagctgttcgccgccctctacccgcgcctggccggctggtgccgccggctggtcgacgacgacgagacggctcacgagatcgcctcggaggcgttcacccggctctgggcccgctggacttccgtggcggagccccggggtttcctctacgtcaccgcggccaacctcgtgcgggaccactggcgcaagctcgagcgtgaacgcagagccgtgcaccgggtcaccgccgaagccgcgctccgcccgccgagcgaacaggccgatccgtcggtacgtctgctcgtgcagtcgctgccggagcgactgcgcgtcccgatcctgctgcactactacgctgacatgccgatccgggaggtgtccgtgctgaccgggcgcaaggaaggaaccatcaaggccgacctccacgcggcccgagaactgctccgtgcccacctcaggagaagccttgatcacacactctgacgacggtccggacttcgaacccgacgaccccctcgccgtcatcctgcggcccccttccgactatctcggcccaccggccggccgctacgaggcgatccgccgcggcgcggcccgccgccggctgctgcgcgccgcggccggggccggcctggcgtgcgcggtcgccgccctcatcgcgctgccgctgcacctggccacgcccggcgcgcccccctcccccacggtccctctcgccccgccgcccgcgagcagttcccccaccgcgcccgccccgccggcgtcgcccgagcccgtcagccccagcccctccgcagggagcaggacccaaagcgccaccaccaccccgaccagggcggccgtccccacccgcgcaccgtcggcgacaccggcctcggcgtccctcgcaccatcggccccggcagccacacccgaaagcagcacccgcccgtagccacggtcagcacggccgcagcggtccgcgggcctcggacggcgcccccagcggcagagcgtgcccgccggatgctccgccccgggcgtccaccgcctcccgcgcgacggacacttcgcggtgtcccgcgcgtcccgcagggccgccacccccgcccgcactcggcgggcttgatgccagtgcctggagcgacacacgccgaacagaaccgggccttcgggccggcgtccggctgaagccgttcaccgcaggccgggcagtaccgggcgggcgcccggccggaaccatcggccacaccaccaggccaggcccggcgggagatcacacttcagcgacttcgaaaaacgggcactcagctctcgtgcgcgcagccggcggccgcctgatgagccgtcagccacccgttgtggtccgagggagccaacacatgccgctccctgccccctgcccccgcgctgcttatgatctacgcctgctactcatgtgccggacggagacatgctccgttcacctgatggaagggtgcgtgtggcactcatacggacactcagaccgctggccgtcctcgcggcgacagccgccctgttcgccgggatcacggacctgcccgcggccgcggacggtaccgcggtgacgaaactgacgctcggcaccgaccagttcaagatgaccgacaccaactacgagtcggcgacgaacaacctctacaacaacgtcctgacaaaccacgccaacctcacggacgtcgtcaccaccgactacacgaagaactcgtccggggccaccgacgcctggatgaacctgcgttccatgcgcgcgtgcgccggcagcgagacgcaggcgctgccgccggtgaacaagaaggtcgcctggtgctggtcctcggcgcatgccgacgacaccacgccgcgctggttcccgcagggcatgagcaccaccggcaccgccgacgggggcgacggcgccatccagggcaagcacgtctcagcggtcgcctggcactacaagacgttcaagaccaactcggccggcgacctcgaggccaacgacggctgcaagacgaacaacctgctcaaggtctccttcatcgaccgggacaccggcaagtaccggcacgtcctgctcgccgagccgaccagcacctcatccagcgcctcgaacttcaagttcgtcaccggccacggcggcggcatcgtctggtacgcgaactacctctacgtcaccgacaccgccaacggcatccgcgtcttcgacatcaacaagctcgccaaggtcgacacctacggctccggcctcaactcctacggcgtcagcggcggcaactccagtgcctgcggctacccgtacgtcctgcccgaggtccactactacaagcaggcgtccacaccggcctcgtgctccacgaacgccgtcgacgggacccccgacgccgacgccctgtgctattcctggctctcgctggacaagaccggcgccggcccgttcaagctggtcacgggcgagtggtacggcaatgtcgccggcggccgggtggtgcgctaccagctcaacccgacgagcgcctcggcctaccccgggctgctgaacatgtccggcggcaagaccgtgatccaggacgcgtacgcggcctccggctaccagggactgcagggcggcatgacctggacggacgatgcgggcctgctgaacttcgccttcagcaagggctgcggcaccaagcccgccgtcttctcgcacacctgggcaggtgacacccgggccgtgaccagctgcgcggccggcggcaactgggcggtcggctcgccgcaggccctcagctactggcccaagctcgacacggcccaggtggacgagctgtgggggctgacggagggcatctgcgccggcacctcactgcgcgcctcgtacccgtacgagttcccggccgtctccgagagcggcaacgcctgcaccggctacaacagttcggacaatctgtcgctccgctcggtcttcgccgtcggtttcaccgacccggcggtccagaacctgcactgacctacgacagcccggctgacccacacccggggcgggccccggacaaaggcgccacccggcgccccgggccccgctccgggcgcatcaccgagcacggccccgcccatggacaagcaggtgcacgatccgccgtccgccgggcgccccgcgtctcccggctgcgcaccgggcgggtgcctccggtgcgccggcccgcgtctcgccgcgggcctgcacggcgcgggccgtccccggcgctgtctgcggccttgctgctcagggccttgtcgccggccgcgtcgcctggtcttctgtactccggccggtcggccacgcgttcgccgccaccgtggcgcacgcacccggcgcgggccggacagcaagaccagcaaggacaggagcggcgtggaatcagtggctgggcaggacgtacggggcatcctgcccgaggggctcggtgcggccgtacgcgataccgccgaggagatcgccgcgctgctgcgcgggggcgccgacatggggcgtggggtgcccgggtcgcagtggaccgtcgggcaggcggcggcgcatctggcgcaggcaggcgagctgatggccgatatcgcggcgggacgcgcgcgcagctggggggacggcacgccgcagagccttgccgcggccaatgagcgggcgctcgccgcgttcggcgagcggagggccgagccgctggccgcgatgatcgtggcgcaggccgatgcctgtgtgacggcgctggaggagagcgcggcgggggcagctcttgtctccccgctgggtccgatgggccccggtgtgctggggtcctacctcctgacgcacatgctcggccacggctacgacctcgcccgtgcgctggggtgtgcgcacatgatcgaccgtgcccgggtggagctgaccctgccgtttttgatcacggccatgccgcgggtgagcgagcccgcccgcacggccgggctgagcgcctcctacgcgatccgcctgtggggcggcggacggttcggtgtgcgggtggccggcggtgcggtggctgtggggccgcggccgccggaccgcccggactgcaccatcctcatcgagccggtcaccttcctgctgatggcactgggccgccgcggtcagtggagcgccatcgcccagggccgcatcctcgcctggggccgcaggccgtggctcgctccccgcttcccggctctcttcacagcgccctgaaccgcagcagacggcaggcggcaggcggcggggatgtgtgcctgcgccgctcacctgtgcccgggtgaggtgagggccgggccggggtgcaggaggccgagcaggctctcgcggtggaggtccgcgatcgggccgaggagatccgggtggcgcagcagcggcgccgcacggtgatcgcgcgggctgggaatggtcagccggcgcgcgtcgcccacgccgttcgcgccgtggtgggttgcggccaggcaggccgctgccacggcggcgagagcggggtcggccagcaggcaggccgcccagctgacgacggtttcgtccacctgggtgcgccaggcgggtgcggcgtccgtgagcgggtgggcggcggcgccggtgacgtggtccagcgccccggagccgccggggccgagcaggttcagcagttcggcgtccagcgcggtggggtagcgcagggcggcggcgatggtggccgcgtgctgtgcctgggcttcggccagcgcatcgttgagcgggccggcggccggcgggaacgccgacagcagccagcgcgccgaggcggcgatgacgggcgagagatcactgagcatggtggtccgttctgtgcaggtgcccgcccggcctgtgcgtggatccggccgcgggcacgcgcgcgcccctcgaggggcgcgcgtgtggcaggcacgtggcaggcaaaggtacgggggccgcccgggcgggcgacaggacctgtgtcacagccggcccggtccggcggggcgcgccactgcccgcggccgcacaggccgcacaggccgcacaggccgcgggcggcgggcggcgggcagtgggcggcggcgggcgcggtctggttccgggcgggcccgtcgtgccgggcggggtgaaccgcgcgcggcgggggcccggcggtgctagccgagcacgcggtcgaggttgaaggccgcgctgatcagggcgaggtgggtgaaggcctgggggaagtttccgtgctgttcgccggtggggccgatctcttccgcgtacaggccgaggtggttggcgtaggtgagcattttctcgaacgcgaggcgggcctcgtccagccggcccgcgcgcgtcagcgcctcgacgtaccagaacgagcagatcgagaaggtgccttcctcgccctggaggccgtcggggctggcctgcgggtcgtagcggtagaccagtgagtcggacaccaggtcctcgcccagcgcgtcgagggtggcgagccatttcgggtcggtcggggagatgaatttggccagcggcatcatcagcagggacgcgtcgaggatgtcgctgtcctcgtactgggtgaaggcgtggcgtccggcggaccagccgtggcgcatgatgcgccggtagatgtcgtcccgggcgcagccccagcgcaccatgtcggcgggcaggccgcggtgctgggccagtcgcatggcgcgttcgatcgccacccagcacatcagccgggagtagaggaacgtcttgcgtccgccgcgggtctcccagactccttcgtcgggctggtcccagtggtcgcacacccagtcgacgagctcgctgatgctgtcccagtgcgcactggacaggggtttgccccatttgtcgtagaggtagagggagtcgaccagcgccccgtagatgtccagttgcagctggccgacggcggcgttgccgacgcgtacgggtgccgagccgcggtagccctccaggtggggcagctcgcgctcgggcagttcgcggcgtccgtcgatgccgtacatgatctgcagcgggcctctcaggtgcggtgcctgggtttcttcgatgcggacgtactcggagaggaagcccatgaaggcttcggcctcgtcggtgaagccgagcctgagcatcgcgtacacgcagaacgcggcgtcgcggatccacacgtagcggtagtcccagttgcgttcgccgccgatctgttcgggcaggctggtggtcggcgcggcgatgatggcgccggtcggggcgtaggtgagcagtttcagggtgagggcggagcggtggaccatctcccgccagcggccgcggtagcgcgagcgggacagccagtgccgccagtagcggacggtcgcgttgaattccctttcggcctcggccacggcgcaaaagcgtggtgtcacgtcgccgccgatccggtcgatggtgaagacggcggactcgccctcgtgcagtttgaacagggaccacacgtcctggcccgcgacctcgatgggcacggtggaggtcagggcgagccggagcgaggacgattcgaagagcgcctggccgtcctggacctgcacggtgtgcggtgcggtgccgaactcgaagcggggggcgatgagcgcgcggaagggcagcgctccgcgggcgcacaccacgcggcggatcaggcggtggcggtcggcttcccgtgagtcgtcgacgaccggcatgaagtcctggatctcgccgaccccctcgtccgcgaagaagcgggtgatcagcacattggtgtcggggaagtagaactgcttggtgcgtgccacaacgtccgcggccagttcgaaggatccgccccgctccgcgtcgaggatcgaggcgaagacgctgggcgcgtcgaagcgcggacagcagtaccagtcgatggtgccgttcgtgccgaccagggccgcgctgcgcagatcgccgatcaggccgtgctcggcgatcggcaggtagcgcagcgggccggcaccgaaaggcacaccgggactgccgcgcgccccgtccctcgctctggcttcggtcgtgttcctcgcttcagccacgtcagcctcccttgggctgtcgcccgggccgccccctgcttctccaggctaacgagtcatcgggcaacggacttgcgggagcggccccgccggggggaacggcagcccccaggggcccgtcctggaggcccgccctggggcggccccgtcctgggggcccgtcctgggggcccgtcctgggggcccgtcctgagggcccgtactgggggcccgtcctgggggcccgtcctgggggcccgtcctgggggcccgtcctgggggcccgtcctgggggcccgtcctgggggcccgtcctgggggcccgtcctgggggcccgtcctgggggcccgtcctgggggcccgtcctgggggcccgtcctgggggcccgtcctgggggcccgtcctgggggcccgtcctgggggggtggggagacggtccggtggctggggtgtcttcctgcctctggtggcgggctccggttactgccttgccggcctggcgtcaagtgacgaatagccggggctggggcggggcgcgcgctccgggcacggtggcagtcgagtgtccgctgcatctgaggagcggacctcgaccgcactggaggctgggatgttctgctggatcggggaggctgccactcgtcgcccgcggctcgtcctcttcggtgcgttcgtcttcctcgtgctgtgtgtggcgctcggtgcgggggccggtggccggctgaagacgcaggggtacgacgatccccgttccgactccagcttcgcggcccgggtgacggccgagcacctcggggcggccccgaacctggtcgtcgtggtgcaggtgcccggcggcttcgtcgacgacgccgccgcccagagggcgggcgaggacctgaccaggcgtctggcggcgcagccgcaggtgagcgccgtgtcctcgtactggaggggccgtgcggccgagttgcgcagccgggacggccgctcggccatgctgctcgcgcacgtggacggcaccggcgaggagctcggtgggcgggtcaagcggctgcgtgaggcgctgaccgctgccgggccgtacaccggcgggtcatccgcccccgggccgtccaccgccgggccgtccactcccgggccgtccgctgcggggccgtccgctgcggggtcttccacgggcggatcgccggccggcgggtcgtccgcccgggcggcggcaaaggggatgccggccctgaaggtgcacgtgggcgggccggctctcgtcgatgccgagctccaggacctttcggagtcggacctgaagcgggccgaggccgtggtcctgccggggacgctgatcctgctggtcctggtgttcggcagtgtggtggccgcactgctgcccctgctgatcggggtcctgtccatcgccgggacgctgctggtactgagcgtgctcggccgtgtcaccgatgtgtcggtgttcgcgctgaacctgaccacggtgctcggcctgggcctggggatcgactacgggctgctgatcgtctcgcggttccgtgaggagatcaccggcgggcacagtgcgcgcgacgccgccctgcgcaccgtgcgcaccgagggccacacgatcgtcttcagtgccgcgacggtctgtgccgcgctggcgacgctgctggtgttcccgccgtacttcctgcggtccttcgcgtatgcgggcatcgccgtggtggcgatcgcggccgtggccgccctgacgatcatgccggcgctgctcaccctgctcggcaagcgggtgaacgcctggccggtgccgtggcgccgcagggtccaggcgggctgcgcgtcgcgctggtgggaggcgctggcgcgccgtgtcgtgcgccgcccggtgctggccgcggtgccggtgatcggcctgctggcggtgctcgccgcgccgttcgcgcacgccggattcgccacccccgacgaccgggcgctgccggccggctcgttcagccggcaggccggggacctggtgcgcggtgagttcggcacgcgcagcgccggggcactgacggtcttcaccacgagtgcgacaccccaggtcgcactcgactacgccccccggctgtccgcgctgcccggcgtggcccaggtggtggggccgttcggtgtctaccgggacggccggcaggtggccgcatccggcccgggccaggccggcccttccggcaccgacagggcggccttccactcggtggtgccgtcggccgacccccggtcgggcgccgcccagcgcctcgttcgcgccatccgcgcgatgcccacgcccgcggacacccacgtccacgtcggcgggccgagcgcggtcctggtcgacgccaaggacacggtcgccggccggcttccgctggcgctggccgtgatcaccctcaccacgtccgtactgctgttcggcttcacccgcagtgtgatcctgccgctgaaggcgatcgcgctgaacgccctgagccttgccgcggtcatgggcgccatggtgtgggtcttccagacgggccatctgcagagcctgctcggcttcacgcccggaccgctctccacgaccatgccggtgctgctgttctgcatcgtcttcgggctctcggtcgactacgaggtgttcgtcctcgcccgtatcaaggaagcccacgacgccgggcaggacacggccggctcgatcgtcacgggcatcgcccgcaccggcggcatcgtcaccaccgccggcgccctgctcgcgttcaccctcctcagcttcggcacctcccaggtgtccctcctgcagttcttcgggatcggcgccggtcttggcgttctcctcgacgccaccctcgtgcgcggcgtcctcgtgcccgcgctcatgcgcctggcgggcggctggaactggtgggcaccgcgcgggctgcgacgcgaccggcccgccagaaacggcccgcccgtcacaggcgatccgccggcgcgccgggcgcctccgccgccgcccgcacggcatgcaccgcccacaccgcccgtaccgcccgtacctcaggtatcgcaggcatcgcaggcatcgcaggcaccggctggtgcaggccctgccgtacctcccgtctcgtccccatcacggcgcacacccgacgtctcccgctccagccacccgacccaggaaggcctctcatgactgacaacgccaccgacaacgccaccggcatcgccatcgtcggactcggctgccgtttccccggcgccggcgacatccaggcctactggaagctccttctgagcggacagcggcagttctccgcggtcccggcaaaccgctggaaccacgacaccttccacgaaccgggcaggcggcgcggcggccatgccgcatacaccgaccaggtcgccttcctggacggcgtggagcggttcgccggcctgcactacggtctgccgcccgcccgtgtgcgggccatggacccccagcaccgtctgatgctcgacgtcacccgcgaggccctcgacgacgcggggtggggccgcggcggcttcgaccgggagaacaccggggtcttcgtcgggatatcggtgtccgactacaaggacctcatgacggcccgtatccgcgccgtcagcctcgccgacgggtccatcggcggcgcaaccgacccccgcatcctggaggccttcagggagcgggccgaggagctgagcacgatccactccttcaccctgcccgggagcctgctcaacatggcgcccgccaccgtcagccggcagttcggcctcggcggccccagcttcgccgtggatgcggcctgctccagctcactgatcgcccttgagacggccgtcgcccacctgcgccagggcacctgccggatcgctgtcgtcggcggcgcgtatctcagcctcacccccgacggcctggtcggcttctcccagctcggcgcactgtccgccaccggggtgtgccgccccttcgacaaggacgccgacgggttcgtcctcggcgaaggcgccggaagcgtcgtcctacgaccgctgccggacgcactcgccgacggcgaccgcgtctacgccgtcatcaagggcatcggctcggccaacgacggcgcctctcccgaaccgctggcccccacccccgaaggccagctgcgggccatgcgccgcgcctacgccgacgcccgtgtgaccccctcctcggtgggcttcatcgaggcccacggcaccggcaccagggccggggaccgcgccgaggcccaggcgctgcgccggctgcgcaccgagtaccccgatgacgatcccgccctgtgctacctcggctcggccaaggccctcatcgggcactcgctgtccgcggccggcatcgcggggctgatcaagacggccctggtcgtccaccaccgcacgatcgtgccgcagccggacaccaccccccacccggacctcgggatcgaagcggccggcctgcgcttcgcccccgctgcccggccatggccgagcagcgggggcccgctgcgggccgccgtcagctccttcggcttcgggggcacgaacgtccatgtggtcctcaccccgccgcccgcccccctcggccatgccgcaggcaccgctgaggtccgcccccgtgcgacgcaccgaagcctcgcccccaatcccgccccgggcaccgccccgaaccccacctcgtgctgatctcggccggcagcccccgcctgctggacgggcaaatcggtgagctgctcgacttcctggaccgctcgcccggcaccccgccggcagccatggcccacaccctgggcggccgcgagatgctcaccgcccggctcgcggtggtggccgccaccccggacgaactggccgggcggctgcgccgagcccgccggcagctcgccgacggcgtccggggcgacctgggcgacggcgcgttcgccgcggacgctcccctgccgccggagcagcgccgtatcgccttcgtcttccccggccagggcagtcagcgccccgccatgatgcacgacctctaccagcggtccggcctgttccgggcggccctggacacgctgggcgccccggcccgcgagcacaccggcctctctcccgcccaggtgctgtacggacagcgggcgagcacccctcccggcgatgcgcagctgcggcagcggccggccggcaccgatgtgtgccagccgctgctcggcagcgtccagatcgccgccacccgcctgctggccgcctgcggcgtcagccccgacctcacgctgggccacagcgccggagaattcgccgcggccgccgcggccggcgcgctcaccgacgaggacaccgtccggctgctggcccaccggggcgccgccctggcccaggccgagaccggcgcccggggcgggatgctcgccgtgcagagcgacaaagagacctgcaggcggctggtccacgggatcgacgacgtgtggttcgcctgcttcaaccacccgcggcaggtcgtggtcagcggcaccgtccagggcctcgccgcgctgcggcgcgcctgcgccgcagcgaaggtcgccgcggtgacgctcgaagtgtcgaacgccttccactcgccgcggctcgccagtgccgaggcggccatgcgcgcggatctcgcccgccgccccgtcacccggccccccgtggcgttcgtgtcgtgcgtgagcgcggccctgtgcagcgaccccgccgagctgcgcgagctgtgggcccgccacgcgtgcgcgccggtccgcttcgaggaggccgtccgcagtgcctacgcccacggcgcccgcgtcttcctccaggtgaccggtaaccgctcgctcctggcctctgtccgccgcagcctcgccggccacggcgacgttcgtctcgcgggcaccgacgggccggcgcccgacagcggacgcggcttcctccaggccctggcccacctcgcggtcctgggcgccccggtggacccccgcgccctgatcccccagcaggaccgccggctgctggacctgccggtggcccggctcgacacccagtcctactggatacggcagccccgccgacccgcaacccccgtgaacccggtgaacccggtgaacccggtgaacccggtgaacaacgaagccccgaccgccggcgtcccgctccggcccgcaccattcggcccctgtggcgccccgcgcaccgaacagccggccaccggccggacgacggccggggaaaccaccggggaagccaccggggaaacgaccgggcaaacggccggggaggcagacgggcaagcggacgggccggcgacttggcaggcgaccgggcaggaagtgctgcacgaggcgctcaccctgctgcgggaacagggcgcgctgctcacccgcctgagcgaagccctcggaacgcaccacgccaccgggccggcggcgcagagcgaggccctgcccatagcctccacagccccggcagcctccgctccccctgccccggcagcctccggcatcccggctgtcccggccgtgcgctgcgcaccgcccgccgacgacgatcctgcggcggcctcggcggacgcagaccgcccagcggcccggaacatcacggacatcacgcagatcagggaagccgcagaggcaacaaaggtctcagaggccacggaggccacggaggccggggaggctgcggaggctgcggaggccgcggagacggtgttcgctcacgtggcgcggatcagcgcgttcccgatcagtcatctgcacgggcggcagctgctgaccgacgatctcggtttcgactccctgatgctgaccgacctgttcgcatccctcaaacggcagtggcccttcctgacgatcgacgagaagacctatgaccggccgaccgtcgaaggcctcatcaccatgatcacggacggctccgcggacaccgcaccgctcaccgcaccgcgcacccggccgacgggccgccgggaggcggcagatgccctcgccgcaccacaagccgtcaccgaaccaaacgccgaaccaaacgccggaccgggtgccggcccaggcgccggtccggatgccggtccggacggcgacgccctgcccgacccgcccgccgtcggcccgcacgcagtgccgccgacgcggaccggtttgcacgcggtaccgccggcgcacaccggcctgcacgcggtgcccgcggcgcgcaccgggcccgccaccgccggcctgcccgagcagcagacacaaatcgagtgcttcccggaggtcaccgcgcacaacgagcgcttggccacgtacagccgactgggcctgcccaacccgtacttcgtggtccatgaacgcggcatgacggacacgaccgtcgtcggcggccgcgagctcctgtcgttctccagctacaactacctgggcatggcaacgcacccccaggtcaacgaggcagccagaaaagccatcgaacgctgcggcacctcggtgtccgccagccggctgctgtccggcagccgtcccctgcacctggaactcgaagcggaactcgccgccaccctcggatgcgaggccgcgatcactctcgtcaacgggcacgccaccaacgtcaccgtgatcgggcacctcgtcggcgagggcgacctcatcgtccacgactccctcgcccacgacagcatcatccagggatgccggctctccggcgcgaggcggcggcccttcccgcacaacgacgcggccgccctggacgccctcctcacccaggtccgccaccactaccgccgcgtcctggtcgtcgccgagggcgtctacagcatggacggtgacatcgccgacctgcccgccctgatcgaggtcaagcgccggcacggcgcgctgctgatgatcgacgaggcgcacagcatcggagtgatcggcgccgcggggcgcggcatcggccagtacttcgacgtggaccgccaggacgtcgagctgtggtcgggcacgctgtccaaggcgctggcgagctgcggcggttacgtcgccgccggccgtacggtggtcgactacctccgctacacggttccgggcttcgtcttcagcgccggcatgactcccgcgaacacggccgcgtccctggccgccctgcgcgtgctgcgggccgaaccgcagcgcgtggcacgcctcaaggagaactccgccctcttcgcccgcctggcgcaccgggcgggcatcgacaccggacccagccacgacacgccgatcatcccgtgcatcgtcggggactcggcgaagaccctgcagctcgccgaggcgctcttcgagcagggcatcagcgtcaaccccatcctgtatccggcggtacccgagaaggcggcccggctgcgtttcttcatcacctgcgaccacacgcccgaccagatccaccacaccgtgcgggaactggcccacgggctgcggcaggcggacaccgcccccgccgcctgaaggcacccctgcggcgtacacccgccgttgcgggcgaccgcaccgggcccggcccccgggccgcggccggatcccgggcagggcaggcatcgacaccgccgcaaagacacccctcttgcaggctgtgcccgggccgaggagcgccgctgacgcggcccccgggcgggccggccggccccaggacaccccggcccgggacacccgggcagcagggcgtagcggcgcgccgcccggtccgtgcaccactacgccgtgcccatgagccgccctgtctcagcggaactcgtggaccacctcgatctccccggccatgtgggcgttgaagtcgtcgagctctgcggccggaacccacagttcgagaatcgtctgcccgccggcctgccggacgggataccggcgcaggaactgcgactcgacctcgaaccgggtgacgaagccggcaccgtcgtgcttcacgttccagtcccgcgcgatcttgaccgcgtagtcctcgttgaggaccgggtagaagaacggctgccccaaaagccgcgcgggccacgcccgccacttcagttcccggaccaggtccagctccttggggccggtggggcgccacagggtcgtcgttccgtgccggctggtcatgtggatcactttctgcatccgggaagccgcgggatcggggatcggcccggccggggagaaggggacgataccgccggcccggacccgccggccacgcagttttcggcaccccggccgccgtgaccggccagacatcacaggacaccaccaaactgacaggacatcaccgagatggcgtcccttgtcgtggtggagccgatcacggttggggagtgcgccgggggcgtgtgctgacctgattgccgctccctgcccgcagggcgggccaccgtgcaactctccgttgtgaaaggccagttcaacgtgggaggtgcagggtggccctgtctcagcggcgacctggacctcgcgatccccaagctgcggtcagggagcttcttccccgcgagctgcggtcagggagcttcttccccgcgctgctggagcggcgccgccgcatcgaccaggccctgtacgccgtcatcatggaggcctacgtccgcggcgtgtccactcggtcggtcgacgacctggtcaaggccctcggtgtggacaccgggatatccaggagcgaggtctcgcgtatctgccaggacctggacggcgagctgaccgcgttccgtgcccggcccctggatcacgtccgcttcccatacatctatctggacgcgccctactgcaaggcgagggtcgagcaccagatcgtgtcccgggccgtggtgattgccaccgggatcaccgaggacggcggccgggaggtgctgggcgtgatggtcggcgacagcgagaccgaggtgttctggaccgagttctgcgtcacctgcgcgaacgcggtctgaccggtatccggctcgtcatcggcgaccatcacgtgggactggtcaaggccatccgcaaggtcatgctcggggccgcgtatcagcgctgcagggttcacttcctgcgcaacgtgttcagtttgatcaacaaggaagcggccgagatggccgccgccacgatccgcacgatcttcgcccagcccaccgccgacgcggtccgcacccagctcgacaccgtcgccggcatgctcggcaagcagttccccaaggttaaggcgatgctgctggaggcgaaggacgacctgaccgccttcgcagcgttccccgagcgtcatgggaagaagatccagtccaccaacccgctggagcggatcaaccgcgaggtcaagcgccgcaccgatgtcgtgcaggtcttcccgaacgacgacgccctcctgcggctggtcaccgccgtgctcttcgagctgcacgacgagtggatcgccttcccccgccgctacctgcccgagggcagcatgagccagctttaccctgctgaactccccgaacaagcccccgcactagcccacaccaccagcacgacggccggttgatcggccacgccacaaggggcacgcgcccctcaggacatcgatgggttgtggacctcgttgcgctgcgggtcaaagcaggtcaagccgtgtttttgcgcaagggcgaagaccgcacgagagaagtcatcggcccgcgaccagccgacgcagaggatcaaccgatgctcgtttacgtcggggctcacgctccacacgaggtcatcgatctcatcgtcatccgggtcgtcggggtcggggaacccgaccagcagatcatccaggagggcaagattccgcgggtcaggctgaacaacggtgtcatcgccggctgccaaactctggcagacaaggagtgcccggtcgaccgtgatcggcatcggctcgtgccagacatagagatcgaagctcattgcaataccacctgcatgatcggcccttcttgaggtgatcaccttcgcgggctggggccagcctggcaagacccacacctccagcgaagcaccgctccagaccacctcaacggcctggtcaccgcggtacgcaagcccactgaacccccaaatgagcccccgcgctacccaacaccaccaacacaacgtcccgttgatcggctacaccacaagaagggacgcgacccatcaccgggccggcgagcaagggcgccttgctgaaccgagcgcgcccggccgggccccgtcggccctcggagccgggcagacgcggcccctggcgtccaggtcgttcgtaccgtggcgcgctccgcccgaacgccaggggccacgcccgctccacggtgtgcgggccgacggcggacgggacgggagccggggtgagttgcgggatggaagggctgggccggtgacaggcccaggaccgcgacgggagatgatccgctcatgcgcatacgacgagaggctcgttggttcttgtggggactgtggcttgcgtgtctggtgttctccatctggttcttcgcagaggtgatcatgctcttcctgcaggccgagtcctggtgacgcagcgaggtgtcgtgcccctgccgtgcccgatcgaccggtaactgacggggagccacggtggttgacggacagcgcacaggagaacggcctctgaccggtttacctggtcaggggccgttcttctgcggtgggtgcgggatctgaacccacggcggcatcgctgccacgacggatttcgagaccgcccagagcctgactcgcccagtgggactctgccggccgcgtggtcccgtggcggcagggacccgcagagagcgtcgccgagcgcggacaacgcgccggtcaccgcctcgtcagggcagcccccacccggccgcgatctgcgctatttgtccgcccggtagagcttgatgtccttgttgacgaaaaggtgcacgtagccgcaccgccagcagatcaggccggtggcgttctcgtcggcccaggccagcttcatgaactccataccggtgctgttgagcaggacaccacgctctcggaacaggtcgcctcggcagatctggcaggtgagccagacctcgcccagtgatgcacgtaccggcttgcttgccatcgagtgaacgccccccgcgtctgtgtggtcagcacgagactacgcacgagactacggcgcagcggagattcggttgcgtgatcttccagacaaacgggtgaccctcatcgaggcggcgcgtgccacgcccgtgccactggccgccatggaccacgcccgctccacggtgtgcgggtcgacggcggacgggatgggagccggggagagtggtgggtaactgatggtggtgaagaacagcgccttccagggggttgcacgtcccgactgagtgtccaatctgcccagcaacgctgtcgaacagcggcagacgagcacgtacgccagcggaccagcaccgcagatgacgtgtacgccagcccatggcacagcccccacccaagctgcttcgggacgaagcagtcgcgtcgctgaggtgcgttgcatgagcggcgacgttctggtctgccctgagtgcagccagcccatgagatctggtggcctcgtgctctccgagcgggaggacgatggtcgacggacctgccgggcgctgtggacgtgcaccgcccgacacgtcctgtggcagtgggccgaccggccggacgagccattgcagctctgccctgtgccacagctgttccgctgacatccaacgctgacatcaacgaccacgaacagccgcgacagtcagcacccggcaatggcccccacacacgagctggaccgcagccgcgcaggggcacgatcgaactcctaaagcgggtgtcggcgtgccggccgtgccacatcccgcggtcaaccgcggtcaacgagggggcacagcagtcgagatgcgcggctgaggcgggctgtgcctgtagcgggagtgacccgagttcctgcagcagccgtcaccaccaggcttaccaggcggggtcaggtgcaggcctgcatgcacggaacggatacccggtacttgcaccatgcttccccggcgctgtcatgcggcatcacggcggccccgcaccacaagcacaccacatccggcgggcaaacagcgggaaagcgcggggagcgggggcgggaaagcggggaagagtgccggcagtgacggcggacccggacaccgcgcagggtccgcagacagccggcctgcccggaccaggctcccaaccggccctggcagagcacggcttgccgagcccaggtccttgagcgcgcagcacggcccccagaatcctgtatgcagccgcgcagccgtacagcgggccggcagggcgccggagcgggcccgggaggaggccggcacttctcgcggcccccgggcgggacgccttacgcccgccgccgttcaactgggcacgtccgggccgccggtagcggcgggatccggccagtgatcagttacgctgaccgctgccgcggcgcagacagtttcgacgcccgggcccctggcgtcccttgcggtgtgatcccaaggcccctgccaggcactttcttggtgaccgcagagggagacatgttcagcaagcgactgatagcggccgcagcgaccgcggtggtgatagccgggctgggcgcatgcggcagcgaaaccgggaacgggagcgggagcggcggcgcggacctggggtcctcctggagcgacgacgccggccggagcggccaggacgccgccccgcacgcccggccggacacggacaccgtgcggggactgcgggactcggtccgccacctctccaggaaaaccgccaaggccacccgcccgcacctggtcaacaagtgcacgcctgccacccggcgggccaagcacacccagcagaggggaacgggcacccggaagaagacccgcacctggtacaccacggagcactaccaggactgcaagaaggtccgcaacggcaccgagacctacacacgaaccgtcaggccgcaacagtggtgcgtgcgcctggacgacgtcgacggcgacacctcccaggacgaccgctggtaccaggtcacccggaccacctacgacgaagccctcaccatggccgagcacacccgcatcgagttcaccccggccggcaccggctgctgaacacacccggacacccgccccccacccgcacagaaatcaccgcctgaacaccccgcgagcgaacaacctgccggccaaccgggccggccctgccgcccgcccacccggcagaccctgaacagcccggcacccccgcccacagcgcaccgaacgggacagagcggggcggagccggagccggcgcggagccggagccggagccggggcggagccggagcagagcccggggcagggaagccggagccggcgcggagcacggaaccggagagcgggatctgcaggagcgggagctgcggcggctgcccggctacgagagctccggcccggtccggatcggcaacggggctgcgaaccagttgcagctcgacgtgtacggctacgtggtcgagaccctgtacctcgcccaccaaagcggtgtggcccgctgcggcgacaccgcggtcctgcaccagcggctggtcgagcaccttgccgagcggtggcagatgcccgacgagggcatctgggaagtccgaggtgagcgccgccacttcgtgcactccaaggtcatggcctgggccgtggtcgaccggaccatccgcctggtcgaggccggcgccctggacgccggcctgtgcgctctgatggaactgcgcgaggccatccgccacgaggtgtgcacccgcggcttcgagccggtttgaggcaccttcacccagtcctgcggatcgcaggaggtcgacgccgctctgctgcttcccgcgggtgggattcctgtcccccggcggcccccgcgtgctggggacggtggaggcggtgcgccggcagccggccactttggagggattcgtacggcgctacccgaccgcaggagatcacgcggggctcgacggcctggacggtgacgaggggggccttcctgctctgctcgttgtggatggtcgacgcgctcgctctgaccggccgcccggccaagcccacggtctcttcggccggttcctggccctgcgcaccgacctcggcctgctcgccgaggagtacgaccacgtcaccggatggcagttgggaaacttcccgcaggcgtacagccacatcggggtgatcgggtccgcgctcctgctgcagcagctcggctcgggggcgcccgcagccgaggccgaagtgctcctggcggcggatgtctgataaacgcgaccgtcaccgccttggtcatcctgcttgccgctgcgacaatggtcgccgtggcagcagcctgggtcgcctaccgccgctggcagatggcgcggcagcaggcccgcctcctggcgcgcgaacagcaggcgaccgcgcgtgcccctgcagaaactggttcacaagacgctgccccagatccaccaggcggccggtcggatcgcagacctgcacgccggcgacgcctgcgtgcgcgaggccctggacacggtcctctaccgcgacccgccgctcgcgaacgtcgcgatggcctacccgccccggccgttggacatcggcggcttcctgctgccgaccggccagccggcagtcatcagctgcgccgcctgcaacaacggccccgccctgggaacacagcgcccgctgggcaaccgggcccacctcgcctggggcgccggcccgcaccgctgcccggccggtgcgcacgcctgcctcatcgccgagatgccctccatgtcctggacaccctggccgagacggacctcgacggccggcgcgccggcctcgcctggcgccccggccccttccaccgctcgctggtcgccctgcccgtcactttccccacgagctgaaagagacctcaacgtgtccgaacagcagataatcgtcctcgacccgaccggatccgacccggacgccgaacaccaggccctgcgcgagcgcgggtccgccgcgctggtggacatcctcggcgtgcgcgcctggtccgtctccgaccctgcgctcctcaagcagcttctgaccagcaaggacgtctccaaggacggccgcgcccactggccggccttcgccgagaccgtgcccacctggccgctggctctgtgggtggcggtagagaacatgttcaccgcctacggcgacaaccacagccgcctgcgccgcatggtcgcccccgccctgtcggcccgccgcaccgcagccctccaggcggacatcgaggccctcgtgaacagcatgctcgacggcctcgacgccttccctgccggcgaggtggccgacctgcgcaagcacctcgcctatccgctcccgatcgccgtcatcggcaagctcatgggcgtccccgccgaccggcgcaccgagttccgcaccgtagtggacaacgtgttcgccacccacctctccgccgaggaacaggccgcgaacaccgccgccctctacgccctgctggacgccctgatcgagatcaggcgcgccgagcccggccaggacatgacctcactgctgatcgccgcccgcgacgaggaagacggctccgccttcagcgacgccgagctgcgtgacacactcctgttgatgatcagcgccgggtacgagaccaccgtcaacgtcatcgaccaggccatcaccaccctgctgaccgacccttgccagctcgcccacgtccgggagggccgctgcacctggcaggacgtggtcgaggagactctgcgccaccagcccgcggtcaagcaccttcccctgcgctacgcccgcatcgacatccccctcccggacgggcagacgatcaagaccggagaggcgatcctcgcctcctacgctgccgccaaccgccaccccacctggcatgaggacgccgaccgcttcgacgccacccgccccagcaaggaacacctcgccttcggacacggcgtccacttctgcctcggcgccccgctggcccgtctcgaagtcgccaccgcgctgcgcctgctcttcgagcgtttccccgacgcccgactcgccacggagcggaccgcgctggaggcactgccgagcttgatcagcaacggacacacctccgtccccgtgcacctgcgcccgacgtccagcgccagtagctgatcgttagctggtgtgacttctgctgctggtgcgtcagttcctcgccggggcccgaaactggagttgttgctgctgtctgatgacgagcgggcggagtcggagcggtgcacgcgccgggcgacaccggcccgggccctggccctgcgggcgcggatcgtgccggcgtgtgcagggccggacgtaccgccgttcgtcgcggtcgccccagagttgcgggtggccgcggacacggtccgaaagtggcggcggcgcttcctcgcccggcggccggacgcactggccggcgagccgaggccgggccggccgcccaccatcagcgtcgatcaggacacgcagctggtcgtggcggccggacgcccactgccgggcaatcgccacggcgcccgcgcctaccgggaatcgggtgcggcccgcgccgtcaagaacgcgcccctcctcggcgacggcggctatcgcggcacacccgccctcatcccgcactggccgcgtaaagaccgaccgctcacgcctcagcagcaagccggcaacgcagtccaccgcagggccagggcctgcgtcgagcacgccttctcccggaggaagacctacaagatcctccgtgactgccgcttacgcggcgacggcgtccaccaggccatcctcgccgtggcccggccgcaccatctggccctcgccgggcaaccccacctcggccagggacactccctgcacttccccaacaccggcttacgggacgtcattcagccggagcagggccgggcggggccaggcggaggcggagcgggaacgcaagtgcgctgtcgccgacaccccaaaggccatcgacgggactcctcccgcgggccgcagcccggcccggaagcggggacaggcagggccgcgggcggggccctggggcgggtatccggtggcgaagcggtgccccagccctgctgctgcctaccgggccgggccgaggtggaggtactcggcccgggccggtgagcagccgcgagtacagagcgcggtgtctgccgggcgcggcgtgtgccgggcgcggcgtgtgccgggcgcggcgtgtgccgggcgcggcgtgtgccgggcgcggtgggtgccgggcgcggtgggtgccgggcgcgtgcgcgggtgccggcggatgcccagggcgtcttcccggcggcttcccgctcggggcggtagtgcgtcacaggcccagggagatggccagccgggtgagttcggcggtgctgctgatgttgagcttggcccggatacggcggagataggcgtcgaccgtgtgcttggacagccccatatggcgggcggtctgcagataggtacgcccggcggcgatgtgccgcagcgtctcccgctcacgcggggccagcacaggagcggaggcgggggcggaggcgggggcgggggcgggggcgggggcttcggcatacggcgcggtgagtgtgagactcatggggatttcctccgacaggtcggtccggtcatcactgctcacaccctcggaagcagaggacaaatgcctgaaagatgctgtttgtcccttttcgaaaagcctggcccgccgacttcatgacgctgtccgccgactgtcacaggcacgtcacagggcacgcccgcaggcaacgccaccccgcgagatcccctcccccgccacccggccacccccggcacggcacgggagcggcacggcacgggagcggcgcagcacggaagcggcgcggcacgaggcggcgcagcacggggggcggagcggcgcagcacgggggcggcgcggcacgaggcggcgcagcacggggggcggagcggcgcagcacggaagcggcgcggcacgaggcggagcagaggcgggcggtgactgcggcgggccgaggctctgcgtgccccggcggccggcaaggcccggccaggccccgccgacggggccgggcagacctgcgaggggggcaggcagggctggcgaccgggcaggccggccggggagccgcggcccggcggggacggacggccccgccgggccggggcaggctggctctgagccggccccgcggggccggggcaggctggctctgagccgccggccgcctcccggggcacggcccgaagcacggcccggggcacggcccggggcacggccggcggcgcggccggcggcgcgggcctggggcacgccccctggcggcagcgccgggttggtgctccgtgcccctcaggatcatgcttgtcaggagggccccggccgtacaggacgcgaagggcgagatgagcggcgatggagcgacttcccacccctgccggccagcaggcggacataccggacgcctcccccgcaccggcctgcacggccaccgccaccatcagtgagcagggcatcgtgacggggtggagcgaaggcgcccgcgaactgctgggctacacgcccccgcagatcgtgggacatcccgccgcacgcctgctcgccgacggcacgggcgaacaggcacggcgcgagacagccgggcgcgagcggttcagcggccaggtggcactcctgcaccgcgacggccaccggctgctgcgcaacctcctcgcgcaccgccgcacaccgcaaggaccgcagccggccgagtggctcgtggtgtccgcggtgaccgcggcctccgcaagtccccgcacccccgacagccaggccctgcgggaatgggtgttcagccagtccccctgcatcctggccgtcttcgacacagacctgcggctggtcaccgccaacaccggcatggaaagtgcgctgctgctccccgaggaacagatgcgcgggctgcgcctgccggagatcacacccggccccgcaagcgaagaagccgaaacaaaaatgcgccgcgcactggaaaccggccagacacagcacatgcaggcctacctccaccccaccggggtgagcgcacagcgcggctggtcgaccacactggccccgctgaaagaccccggcggaacggtgcgcgccgtatgcctggcagcccaccaccgccagcaagaacacctggcccggcagcggatgctgctgctcaacgatgccggagcccgcatcggcaccacctccgacatccagcgcaccgtgcaggaactggccgacgtcgccgttccccggctcgccgacttcgccgccgtcgacctgctggacgtcccccggcgcggcggcgaacccgcccgcctccccgccaccggccccatcaccatgcaccgcaccgccctgcacaccacccccgacaaccacaccagccacaccagccacaccagccacgacggcgacgacggcgacggcggcgacacgcaccccgccaccccgcccgcagccggcgagaaaatcctctacccggcacagtcaccggtggcccagtgcctggcccagggccacggcgccctgtacgaagcagacgaccccgcactcacccgctgggcagccaacgaccccacagccgcctggacccgccggcagggaacccactcggtgatggtggtacccctgcgcgcccacggcaccaccctcggcgtcgccctcttcgcccgcagccaccgccccgaacccttcgaagcagacgacctgtggctcgccgaagaactcaccgcccagaccgccgtccacctccacaacgcccaccgccacgcccgcgaacacaccaccaccatgaccctgcagcgcagcctgctcccccagaaactgcccgaccagggagcactcgacatcgccacccgctacctgcccgccggcagcaaagccggcgtcggcggcgactggttcgacgtcatccccctctccggcgcccgcgtcgccctcgtcgtcggcgacgtcgtcggccacggcatccgcgcctccgccaccatgggccgcgtccgcaccgccgtacgcaccctcgccgacgtcgacctgccccccgacgaactcctcacctacctcgacgacctcgtcatccacctcgccgccgacgaaggcggcggcgccgaaggcaccaccgaaaccgccgcaggcatcggcaccacctgcctctacgccgtctacgaccccacaacccgccactgcaccatcgcccgcgccggccaccccccacccgccgtcgtcacccccgacggcaacgtccgcttcctcaacgtccccgccggccccccactgggcctgggcggcctccccttcgaaaccctcgaaacccaactccccgaagcagcctcctcaccctctacaccgacggactcctcgaaacccgcgaccacgacatcgacgaaggcctcgacaaaatgttccacgccctcgcccgccccgcccacaacctcgacaccgtctgcgacagaatcctcaccaccatgctcacccaccgccccgacgacgacatcgccctcctcatcgcccgcacccgcgccctcaacaccaaccaaatcgccaccttcaacctcccctcccaccccgccatcgtcgcccaagcacgccaacacaccaccacccaactcaccacctggaacctcaccgacaccaccttcaccaccgaactcatcgtcagcgaactcgtcaccaacgccatccgctacggccacccacccatccaactccgcctcatccaccacaaccacaccctcaccaccgaagtctccgacaccagcaacaccaccccccacatgcgccgcgcccgcacctacgacgaaggaggacgcggcctcctcctcatcggccaactcgcccaacgctggggcacccgccacacccccaccggcaaaaccgtctggaccgaacaaaccctcacccccaactaatactgaattccgctttcgttgggtatagcggctggtagcggggcagttgcgggtgctcggggccggtgctgggtagtggtgctgagggcacggccgggccgtgacgagggcgagcgggagatggtccaccgcctggcgtcggccagaaaggcgccgaaggttgtggtggagcgctgtcggacggtggagctgagctggggcgggtggctggtgccgcagatagccgacgagctgcggtgcggtgtggggcaagcccgcaccacccacccgaaccctcagacgccgctacacgtacaccgtttgaggacagcactaataggactccattaggtcttcctgtcgggcctgttcgggagcatgttgggtgtgtggacgcacatgaagtgaacagtgtccgggcgacgttggcgttatacatcgctgatgtgttcgtgtcgatgccgcgcaaggaccagcggccaagggtgactgctatatgcggggactgatgctggacggtcgccgcaagtcgatccaggcgatggccgcgcggttgccggacggcaacgagcagaacctgcagcagttcgtgaaccagtcgacgtgggatcccgtgccggtgcagcgacggatcgccgagcggatgctgccgttgatcaacccggtggcctgggtgatcgacgatgtgtcggtgcccaaggacgagaggatgtcggtcgcggtggccccgcagtactgcggggctctgggcaaacgggccaactgccaggtcgcggtcaccgtccacgccgcgaccgacactgcctcctgcccgctgcagtggcgcctgttcctgccaaaggagtgggcctcggacaccgaccgccgggccatcacccgcatcccacccgaggtcgcgcaggcactgtcacgttggctgacggggtgggatgatctcctggttgatcaagctggtaggggtcgtccgtggggagcacgtcgccgtcgtacagggggcaccggtacccggtcgaggtgatctcccactgcatgtggctgtacttccggttcccgctcagcttccgcgaggtcgaggagctgatgctccagcgaggcgtcatcgtctcctacgagacagtgcgtcgctggtgcgccaagttcggccaggcctacgcgaacggactgcgccgccgccggccccggcccggggacaagtggcacctggacgaggtgttcgtcagggtaaacggggagctgaagtacctgtggcgggccgtcgaccaggacggcaacgtactcgacatcctcgtccagaaccggcgggacaaggccgccgcccgacgcttcttccgcaggctgatgaaggagacccggtcggtgccgagggtggtcgtcacggacaagctccgctcctacggcgcggcccaccgtgaggtcatgccctccgtcgagcaccgctcgcacaagggactgaacaaccgggccgagaatagccaccagcccacgcggcagcgtgaacgtgcgatgaagggcttccgcagtaccggtggagcccagcggttcctgtccgcgttcagcggcatctcaccccacttccggccccaccgccacctgatgacagcctctgaccaccgagccgagatgaccatccgcttcgccatctgggaccagatcaccggcgctgccagccggcccaccacggcctgaacaacaggcccggaccgcaggcccaccatgccccgacgcaccatcagacagtcacgcacccaacaacgtgacaacgccctgcccggcgttccgaggcggtggcgggtcaggcggcggtcggtgccggttgtcgagccaccctccgagccggatacccacgccatcctctccgtcttcaccagccatgttctcgacatgcttccttgggactcgcaggtgaccttcgcgggtgtggaactggcgtgccgcggccaggtggggtgggtggcccaccggttggcctgtgtccggcgcgcaggcggctgctcttccccgttggcgggttcgagtccgaggacgctgtccagcagcctggctttctaagcgggatctgacaccacttgtcgttcagggacgacacgcccggtgcgggcggagagtgctatcgccgagttttgacagtacttggggtcttgcgatgggggatggctgtgcttgttcgtgatgaaggggtgccgatgccgcccaagtccgggcaggacgcccccaacaggcatagggtcggcggtgacaggcagcacggggaggactggttgagcgggggtaggtcaccgtcgccggattggcggaagccgtcgccgttgggcctcggggtcgccgtggacgccgtcaccaatgtcgccgccccgctgctggcggggttcgcgattgccaccatcggggtcgtcggcgcggatggcggccacttccgctggcccgggccggtcctgctgtgcctgacgctgtcggcgctgctgtttgtcacctgcgtgcagttcgggttccacgcccggcggcacctgtactcgttcgcggacatctctgcttggtggtcggacgaggagatgagagatcaccgcgacctgctgcgcgaggagcagaacgccgacttccagctctggaaccgctggcgcgggcgggcctacacggcgtacagcggtggcatggtcatgctgtggctgggggtggccctggttctggtgccaccggcacggagtacatcgcctgacacggagttccgctgggctgcagccgctgtggcggtcggcgccgccgtggttgaggccgtatggagcatgtatccgcaggtaagactctggtttcagcggcgccgagtccttagggggaacgcgtgacggacagcacgggaagtccgggagtacccgacgaacagcccatcgagccgagaccgaggctggacccggagcgcagagcgccccaaccagtaccgccgccgtggcagtcggcgccgcaaccagtaccgccgcagttgccgcaggcggcgccgcctgcgagagccgactgtccgagttgtcatcactcgcgaaggcatcatcggggctgcgagctggagtcactgagcgttgagctcgcgtccttgctcggctacacggcggcgcgggaccgcgtcccagcaatggatgacggcgaggaccggtccccgtcccgtccggttcccggcggagtgcgtgggtggctgcaccgactgcttcggcgttgaccccgagccgtcgcaccggcatccggggcccgatcgcatttgtggggtcctgccgcagcgacaggcggtcaaggccgggatggtccccggaaggaccgctccagcagcggagagactgcggcgatcacaggccagactcgcctgctccaccgctggtttcttcgctggcaacaccgggtcggtgtggctgttggagaaggtgggctgccagcgaaccgagacgctacggcacggcggtcattgagcaccttgtgccggtattccacagcgaccattgcttcctctgggctctcacgtcccagtctccaggtgtccacgatcaaggggaagcttcactcgggcgctgcaccaccattccgggtgtcgatgaccgtgacatccaagaggctgtccacctcgcgcatcagcagacgagaaagctcagcccggcaccgtcgggcggccagaagactctcttgcgcctctgtaagagttgcatcaaaaccctgtgccgtgggtcctatccttatcgctcgccgcaactgaaaagaggtcctgttgagcgcgtccacaatcaggaaggcatccccggtgactgatgggtgacgcgctgactgtgcggcgacacgttcttccacggcaggggaaaaacggattatgccgcgggagagctctacttcggcgctgactgtggtcagcatgatccgtagcccatcctccagcgcaccgtacccggcgctctgcagggcatcccggcagcgatagtgggccgccaagaactcactgaggtccagggccaagcttgactcgcggctttgctccagatcaatgatcgtttgatcgaggaggtcgtaccacgcggcaactgcctgacgaaccagcaccacacgcgccacggccgccttgcgcttctccacctgctcagttgcctcggagtccgctctggcaaattcccgatctgcctgcatctctagccgctctcgttgccgaagttctgcctcgacgcgtacgagttctcgctcttccctcgcctgcaacagtgcccgcttctgaacctgaatagggccccagtaggccacagccccggtgataagagtgccacccaggacaccgaacagaccgtaaagtgcctcagacatggtgttccccgtatcgcgaggggccgaaggcctcaagcccgacaaagcgtctcagcgctctagcgtcaccagctcagacttcgcccacgaagacccggcgctcacgcctccatgagccgaagccaaccgcgggccttctcaggtagcactgtagaaccgccgggccacctctccgtcgccggcccccgcctcgatcaagtcagcggctgcaagacggacttgttcgcgccgatcccgctcctcggccgtcaacccaccaccatcgggatagctcatccttccggcatagcgcggcccacgacaactgtcacgaccccacgtaacccacacccttaagacggcgtttcttatggcgtgatcgttcgttgaaccgtgtatgacggatctggttgagcggctggtgccggatgagttgtgggtgttgttccggcgggtggtgcctccgacagaggtgatacgtccgcagggcggcggccggcgccgggcgggtgaccgcgaggccctggccgcgatcatcttcgtggcgacctcgggctgcacgtggcggcagctgccgccggtgttcggcccgagctggcagacggtctaccgacgcttcgcccaatggagccgggcccgtgtctgggcccggctccaccgcgtcatcctcgacgaactcggtgcccgcggcgagttggactggtcacggtgcgcgatcgactcggtcagcctgcgggcggcaaaagggggccactgacgggaccgaatccgaccgaccgaggcaagttgggatcgaagatccacctgatcaccgaccggaacggactgcctctctcgctgggcatctcaggcgccaacatgcacgacagcctcggccttgaaccgctcgtgcgcgggatcccgccgatccggtcccggcgaggaccgcgtcggcggcgacccggcaagctccacgcagacaagggctacgactacgaccacctgcggcgatggctccgcaaacgcggcatccgccaccgcatcgcccgcaagggcatcgagtcctcaaagcggctcggccgccaccgctgggtcgtcgagaggaccgtgtcctggctcgccggctgccgccgactccaccgccgctacgaacgcaaggcagaacactgcctcgccttcgctgacatcgccgcagccctcatctgccaccgccgcctcaccaaatgaaacgacgtctaatactgcaacggtgcttgccgtgactggtggccagttcagtcgttggtctggttatgggtggggaccttgctggtgtcaggttgtgggcgggtgaactcgaggcggtgcacgagcggttcgtgcaccggttcagccgggaagagccgcgtcagtcggcgctggcctatatgcgggggctggtcgcgccgctggagcggaagaacggctggacgctggctgaggaggccgggcatgccggtcccgatcgcatccaccggttgctgaaccggatcgagtgggacgccgacgaggtcctggacgacgtgcgtgactacgtcgtcgagaacctcggcgaccgggatgccgtcctgatcgtcgacgacaccggattcctgaagaagggtgtccgttcggccggggtccagcggcagtactccggcaccgcgggacgcacggagaactcccagatcggggtctttctcgcgtatgcaacgggccgcggacgcacgctgatcgaccggcggctgtatctgcccacgtcctggacggatgaccgcgagcgatgccgacgggcaggcatcgacgacagtgtcgccttcgagacgaaggtggccatggccaaggcgatggtccgccgggccatcgccgacaggatcccgttcggctgggtgacggcggacgccgcctatggcttcagcaagggctggcggttcgagctggagcaggcggacgtcttccatgtcatggccaccacccggcacgacaccgtcgtcacccgctggtccatcgaccaccccgtccacgacctgttccccggcctgccccggcagaaatggaaacgccgttcctgcggcgagggagcccacggccggcggatctacgactgggcccgcgtcgaggtgaggccctggcaccgcgaggaccgccggcactgggttctcgcccgccgcagcgtgagcaggcccgaggagatctcctactacatcgcctactgtcccgccggcaccacgctggacgagctgatccgcgtcgcgggcagccgatgggccgtcgaggaatgcttccagacggcgaagcaggaatgcggtctggacgactaccaggtccgccgctaccccggctggcaccgccacatgaccctggccatggccgctcatgcctgcctgaccgtcctgcgagcccgtgaactggacatcgggaaagcagaaacggatcctcccagctcatccactacagcctcgccgagatccgacgactgatcacccgcctcaccgaccgccgccccaccccgatcgaccacatcctgcattggtcgacatggcgccgccgacgccaacaccaagcccgcatcagtcactacaaacgacgcggacacagcccctgaaacctgcccaacactcagaacaagcaccgttgcagtactagtgtcgaacgcagcgaccagtggcctttgttcgtggaatctggacaccactggtcgctcaggccgagagcacccggtttcgccggagagcgactcttccagcagcgcgtcagcaagagcgccgacattcgccttaccgccgtcggcgatcacctcaccgccgtccggatcgacggctcacccgggatcgactggcgccgccactacgaggcactcacttacaccccggtccccgtcccgcccgagatcaccaaaggggtccgcgcctacctcgacgccttcggcctggtcttcggtgccttcgacttcggactcggcacagatggccgctggcactggtacgagtgcaaccccaacgggcaatgggcctggttccccgacaacatcaccgcccccatcaccaacgctctcgccgaccgtctccagcacccccaaggaactttccaatcgtgttgtcaagccgctctcgtgacgggaggtgaagtgtgaaagcactctccgtcacggatcatcgcccacagaacgttgagtcgtcggcgtgcgagagccagcagggcctgcttgtggcccttgccctcgcctcgcttccggtcgtagaacgccttcgaggcggggcagcactggaggctgaccatggccgacaggtacatggttctcagcagaccacggtggtagcgccgggggcggcgcaggttgccgctgacacggccggagtcacgtggtctgggggccaggccggcgaagccggccaggcggtcggggctgccgaaggcgtccatgtcaccaccggtcgcggcgaggaattcagctccgagcttggctcccatgccgggcagactgcggatcacctcggcgtgcggatgctcgcaaaacttgacctcgatcagggcgtcaagctcggcgatctcctcatcgagggccatcacccccttcgcgaggcggaccaccatggcggcggccagcttctcgccgggcagcgcggtctgctgggcctgggcggcctccacggtcgtcttcgccagtgcggcggcacccctgactttgcggttcttcaaccacgtctcgatccggctcgcgcctgctcgacggatcgcggccggggtctggtagccggtcagcagtaccaccggcccccggttcgtcagttccagggcacgttccagcgcggggaagatctccaggagttgggcgcggagacggttgatctgccgggtgcggtcgaagaccgcgtccagacggcgggtggtcagcgtgcgcaggtcgacggcgatctcatcgccgggccgcaacaggcccagatcgcgacggacgcgggcctggtcggcgatgacgaaggcgtccttcgcgtcggtcttcccctcgccgcccttgtaggtggccgaggcacggtggaccgccagaccggtcaggtaggcgaccggctggccgtggctgaccagcaggccgatcagcagcgcggcaccaccgtgattgaggtccacagcccacagcgcgtcggcggatatctccaggacatcgccgatcagggcaagcagttcactctcgtcatttgcgacccggcgggacagcagacgcttgccgtccgcgttgatcaccacgcagtggtaatgcgtcttgccgatgtccactccggcccagatctcgggcacgttcccctccaccagctcgccctacatcgatcccgcagacgacctcgccgacgtcgtcctacgcagcgatcggagtcgcatctcccaattggcggtcgagtcgtcgcggggctccgggcggccaagttccttgagccatccctacggcgccccaatgacagccatacccagaacccccgggccctccgatcttacgaatgaccagagcaaccacccttgaaaggtaggaccccatgaccgaccccgccgacctgcgccgccaactcgccaacaccatccccacggatgaccccgcctggcgccatgccctccaaagcgtgccacgcgaaatcttcctcggcgacgccttgttccgcctcaccggcccccagtgggaacccatccaccgcgaccagaccgcccccggcgagtggctgcgcctcatctaccaggacaccacctgggtcacacagatcgacggcgtcaacgcggccgacgcctgcagccccacgaccggccgccccacctcgtccagcacgctgccgtccctgatcgtccgcatgctcgacctcgcaggcacccgcgacggcgacaacgtgctggagatcggcaccggcaccggctactccaccgccatcctctgcgaacgcctcggagacgaacacgtcttctctgtcgagtacgacccgggcctggcagccgcggcggctgaccacatccacgccgccggttaccaccccaccctgaacaccggagacggcctggccggacacaaggacggcgccgaatacgacgcgatcattgccacctgcgctgtccgccacatccccccgacctggctctaccaagtacgcgccggcggcaccatcaccaccaccatcagcggatggatgctcgcctccggcctcatccgcctcaccgtccacgacgacggcaccgccaccggccgattcgccgacgaccagatcagctacatgctcgcccgcccccacgaacgcccaccccgccccacgtactaccagcaccccggccacacccgccccacccgcgtaaaccccgccctcctggacgactggaccggccacttcctcgcccagctcgccgcaccctcagccgaactcatgaacaccaccgacggcgtgatcctggtggacgtcgccaccggatcacaggcatggaccgaaccagccgggaacagctggcacgtccaccagcacggcccgctcaacctctgggaccaggtggagaacaccctcaccacctggcagagggcaggctcacccccacaatccgacctcggcatgaccgtggaaccggacggcacacaacgggtatggctcggggcccccgacggcccctcatgggacctgcccgtctagcaccgcacgcaccgaggtacgagaccatccgccccggacgacaagccgctgaaccaatcgaccaggaagcagtggtggccccctggttgtgggcgcgctcgtgggcgaagagagcgtcgcgctcgtcgggtttgaggctgcgcagcatggcggtggtgacgacgatgcggtgcgggcgtccgggcagggcgtaggcgtccgggtgcggtgagtcgaccacgcacagatcgccagcggtaggtcgccggtcggcctcggcgcgggcggtgcggaaggcgcgcgtctggcgcagggccgagtgtgcgagggtccaggcgccgatggtgagcaggccggtggcgatcgcggccgcgggcaggaccaggtagcccgtgggcgtgcgcagggggtgggcgagttcaccgagcgccgcgaacgccggcagcttgagcagtccggtcaggacgagtgcgcccagggcggtcacgcaagcacccgccagcaccagggcggcggcggtcagcgcccacagagcggtggcaggggccagtcggtcgagggctcgccgggcgagtagcggcatcacgaagggcagcagcagcggaatcaacagaggacggtcatccctcgtcggcctccagtagctggcgcagaagctgttcgtcgtccggatggagctgggcgacgaagcgggccaggacggtctcccggtcagtgtcacggtcgagctcggtatgcatgcgccgggcggtgagcccctgggtgtcctgcacggggtagtaaccatagccacgcccctgcggtcgacgacgcccttgtcgtacaggcgggacaggatcgtcgtcaccgtcgtgcgggccaggtcggaggcgagttcggcctgcacctcacccggggtgagggccgcctcggcggcccacagggcggccatgacggcggcttccagctcgccggccggtcggcgctcgtccttggcgtcggtcatgggaacgatcgtcaccccatcttcgtctacagttcagtagaccgtctacagaattgtagtcacccgggtggcgctttcgcgtgcccccacccatccagtatgagagggcccgcgttcatgaccgcacccctgttcgcagcctcacagctcgcggtgaatgtcctgagcgcgcagtccctgctggccgccttcggtgtgctgggggtcggcgtggtgatgttcgcggaaaccgggctgctgatcggcttcttcctgcccggtgactcgctgctgttcaccgcaggcctgctgtgcacggggagcggccagcacggggtgaagctgtcgctcgctccgctgctagtggccgcggctgtgggtgcccttgccggtgcgcagtgcggctatgtgctcggccggaaggccggcggggccctcctggcgcgcagccgttcggtccgcctgcgcgaaggggcccagcgggccgaggagttgctggagcggtacgggcatgcgaaggccatcgtgctggcccggttcgtgcccgtggtgcggacggtcctaaatccgatggcgggcgcgttgggcgtaccggcgcggaccttcaccgtgtggcaggtcgccggcggactcgtgtggagtctggggctcacgctgggcggctacgcgcttggttcgtccatccccaatgtggaccgctacctgctgccgatcatcgccgtgatcgtggccgtgtcgttgcttccgctcgctgccgagctctaccgctcccgccgcgcagccaaagcgaaggaggtacgtggatgatcctcgccttcgacggctcctcgatcgacggcaccgcctacaccgacgtggtggatctcgctcaccgctcgcccggctggcttgacgacatggtggcggcctggtcgacgtacggactggcggtgttcgccgcgctgatggccgtgggctggtggcgggcgcggcgggtgagcccggctgccgcggtgagcgcgctggccgttccggcgatcgtcttcgccgcatacggggtgaacgacgtgctgaaactgctggtacgcgaggaccggccctgtcagagcctgcaggtgatcacgctggaggcgtgccctgcgccgggcgactggtccttccccagcaatcacacggccatcgccgccgcggccgccatggccctgctcttcgtctcccgtcggctcggcgccgtcgcggccggggccgcctgcgcgatggcagcctcccgggtctgggtcggcgcgcactatccgcacgacgtcgctgcaggagtggtcgtcggcgccctcgtcgcggcgctcgcgatggtcacgctgcgccgccagcccgattccctggtccggtggatcaccggtacgcggctgcgtccgctggtactggcgtcatgaaacgcagtgacctcggcgagctggccggcagcgtcggcttgggggcgtggacggcattcggcgtgctgaccatgatcgtgatcggcgacggccagccgctgtacggggatgaggacctgctgtcctggtccgtcgggcaccgcccggacgtgccggtggcgctggcccgcgccctgaccgccaccggaaccggcgccatcccgtacgtcctcgccgtactggcgggaaccatcgccggacgcaccctgcgccaacgggccgtcgccaccgcgctctgcctcacctgcctcggcgcggggcaagccgcgcggtacggcgtgatggcgctcgtcgcccggccccgccccacccgagtggactgggccacacccgcctcggggtgggcgtttccctccggccacaccaccacggccgccctgaccgccggactgctcgtcatcgccgtgtacacacgctccccgcccggcagggccctgctcgccctcgttttcggctgctggggcgcgctggttgggctgacccgcgtctacctcggggtgcactggttcaccgatgtcgtcggcggctggctgttcgccgtcggctggctggggctgtgcctgtgcgccgctgcctggtggctgcccgaagcgttcatcacaggtacgacggacatagaccaaaagccgccggaggaccatgcgccacaagatcctggtcgtcgaggacgatcacgccctgcgtgacgtcctgctgcgcggcctgcgcgacgaggacttcgaccccgtacccgccccggacggggcatccgccctgcggctggccacccgtgacatcgccgcgtcggtcctggacatcgggctgcccgacgcggacggccgggacgtgtgccaggcgatgcgggcgaacggattcctctcccccgtcatcttcctgaccgcccatcaccggctcaccgaccggctgtccgggttctccgccgggggcgacgactatctgcccaagccgttccacctcgccgaactcgccgcccgactgcgagcggccgtcaaacgagccgcaccacttcctgcggccacggccggtgatctggtgctggaccccgtccggcacagcgtcagcgtgcgcggtaccccggtcgacctcacgccgacggagttccgtctcctggcggcgctcatggcggcatccgggggcatcgtgcgccgacgcgagctggtcagagcggggtggcccgagggagcccaggtcagcgacaacaccctcgaccaatacctgacccggctgcgccgcaagctgcgtacggcgggcagcgatctgacggttaccaccgcccgcgggatcggccaccgcctgtcatgaactccatgttctcccgcctggtgccgcgcaccctgcgaggccgcctctccctggtggccctcaccaccgccaccctcctgatggtggtcctcaccgtcgccttcaacaccgtcatccggcaccgcctccagcaccaggccgacgacgagctgcacacccgggccgccgccgtcgccaccaccatcgacaccagcggccccacggtgcgcgtcctggagacctccaacgaccagctcctcgacacgaacgtgtggatctacgcgggcacccggctgctcgaacagccgccatccaccacagcccacagcaccctcgctcacgccgccgacagcctcgcgcggcaggatgggacacactgcctgactgccgaggaaccagaccccgcccagctgtgcagcctgcccgtatccgacggccggagcacggcgaccgtcgtcaccgcgctggacctctccccctaccgcagctcggcagccaccctgctttgggcatcgctgtgcctcgacgcggtgatgctcgcctgcacctacctactgacacgcctcgccgtcggacgcgcgctgcgtcccgtggccaccatgaccgaccaggccacccagtggagtatcgtcgcctccgaggaacgcttcggcgccgctcgacgtccgaccgaactcgcccgtctaggcgcgtcgttggacgcgatactggaccgcatccgcgccgtcctgcgccatgagcagcagctgaccggcgagttgtcacacgaacttcgcaccccgctcagccgcatcatcgccgaactcgactggtggcaggcccgcccccgctcggccgccgaaaccgaagccacccacgaggtgatcgctgacgccgcccggtccatgcgcagcatctgcgacaccctgctcaacgacgcccgcaagggcacgaccaccacccccggaacggccgagatcctcccggcactccaccgactcgccgcatccctggaggcaccggtccatgtgacagtcgacgcacgtagcgacagcgtcccgctggaggccggcgtccaggccgccctcctcgaacgcatcgtcagcccgctcctcgtcaacgccgtccgctacgccacctcgcacgtcaccatcaccgcgagccgggagcccggcggcgtacgcatcgacgttgacgacgacggtcccggggtacccgagtcgttcgcggcgcagctcttccagcccggccggcgggccgaccccgacgacggacgcggcggagcgggcctcgggctgccgctcgcgcgacgcctggcccgctccgtcggcggtgacgtgacgtacgaccccggtcacaagcccggggcgcggttcaccgtcaggctgcccgctgggtgacggcctcctgctcggctgactccggactcgagagggcggtccggcgctcccgcacctgggcatacgccatcaggcccaccaggatggccagcaggacggccgatgaacccgcggtgccgaggtcgagaccgcccttggcgaccggcttggtgaggaagtcacctgcggtcgcgcccagcgggcgggtcagtacgaaggcgaaccagaacagcagcacgttcggcaccacgggcaccttcatcaggacgagaagcatcgcgagcatcccggagacgagcagcgcgccgcccgcgtagccgaggccggagctgtcggagaggaagtcgcccatggacgtgccgagggtgttggagacgagaatcgctgaccagaagagggcttcgccgcggaaggtgacgatgtcacggatgacgaacgtcatcccggtcagtttccacaccgcgaagacggcgatcaggagagagatcaggatcgcggcgccgacggggtagcccaggcccaggccctgcgggccccagcccagcgacgtggccccgcccgagaggaacttggcgctggcgtcgcggttcatgaagtcggacatcgtcgtaccggccatgctggtggacaggatgaccgtccagtagaagaacgggttgtagcggcgggacctgagctggaccaccaaggtcaccacgaagatcaggaacagggcgatcgtggtgaggaagtagccgagcttcagggtctgggcgaacaggtcaccggccgtctcgcccagggtcgtggcggcgatcttcatgatccagaaggccagggtgacctcagagcttcttcatcaccgacctggtcgtactggcgacatccaggtcggtgaaaagttctgacttctccaagagggagtgctcctgttcgtgcagggcgcggggcgctcatcaaagggcgagcaccccgcgagacggtggggacaaccgcgcgcggcgcggcggttgcgtcggtgtccgaccctgccagtggtgatctgaacgcatcctgaacgccggcgcgacgcttacgccgtacgggcgaggcgctccggctcggtgacgtccttgcgcgtcaccgccaggaacaccaccagtccgaggatgaccgcgaggaacaacacgctggtcaccacggtgcccaggcccaggccgccgtcaccggtcggctgggagaggtagtcgcccatcgaggcgccgagcgggcgggtcaggacgtaggcgatccagaagctccacacggcgttcgccccgagcgcgaagcgcgccaccgcgaccgcggcgatcgccagggcgaacaggaccgcggagacccagtagcccagcgccatgcgctcggcgaccaggtcaccggccgacgtgcccagcgcgaaggtgaacaggaccgccagccagtagaaggactcccggcgcagggtgtcgatgctgtggatggacagcgtccgctcgctgcggtaccaggcgacgaacacgaccgccaggaggaccgcgaacaccgcggtggtggtctccagcggtatgcccatgttgtcggtcaggttgtcactgaccagggtgccgacgacgctgatcagggccacggccgtccagtacgcgccgggccggtaggcggtggtacggaactgaacgacgagaatcaccgcaagcagcacgctcatcagcagcgacacaccggtcaggcccagtccggccttctcgttcagcaggtcggccgcggtctcgccgaccgtcgtgcacagcaccttgatcacccagaagtacacggtgacttcgggcaccttgttccagcgcagacggtggccgggggcgttcggggcggacccgtggaccgccgctgtctcagaagtctcagatgtcatgaggcccgaccgtgccaccgggaacctgaacacatcctgactgccgcgcggcatcacccgcccccgccggcccgcgcggggaacatgtctgccatgcacagcgacacggcccacccggtcataccggcactccgtcccagcccagcccccacgacggaagcgtgctgccatgaccatcccccactcccacggccgcacctgtgccgaccacgcgacgcactggctgcgccgccgcctcggacgggccgtcgcgctcgcgtatctcgccgccgtgctgctgcccggcccgggccggtggctgcgccacacgcataccctggtggggactggactccccctgtacacggcctcgttactgctctcgctggtcctgttctcggccggactacaggtccccgtgcgagcactgggacagctgctgcgacggccccgggcctgctggcagggctgatcctgcatctcgcggcgccgctgctgatcatcccgctggtggcgttcctgctgcgccgctcgccggataccgacggcggcagcggtctggtcaccgcgatgatccttatcgtcgcgatgccggtggccgcgggggcgacggtctggaccggcaaggggcacggtgaccagccgaccatggtcggtctcgtcctcgcctccacgctggtcagtccgctcacgatccccgtgacggtgggcgcgctggcgccgctgctcagcggcggctacccggacgcgctgggcccggccagggacacgatgaacagcggtttcgccttcgcgcaagtcgtactgccatgcgcggcgggcctcatgtgccgtctcgtcctgccggcgcgcctgctggacggtgcggggcgctgggtcgtgcccgtggcgctggccggctcggcggtcctgacgtacgtgaacgcgagcggcgccctgggtgccctcctggcccatccccgtccgctgctgctgatcgcggcaccggtcgtggcggcggtcgtctgcgcgccgtccttcgcggtaggacgccttgcggcgcgcgtcctgcgtctggacgccccggccgcctcctctctcaccctcgcctgcgggatgaacaacagcagcgcgagtgcggtcctgatcaccacgaccctgcccgacaagccgcacctgctgctgccggtcctcgcgtacgggctgttgcagaagacggccgcgaacagggtcgtacgcatgactcgccctcaccgcccgcccggaccgccctgccccgcctcgtcctgaggatccccatcgccccggcgaccgtccgactcgtttcggtcttccgccccgtgtcctcctgcggcccgtaccgggagcagcagcgtgaacgtggtcggcgcgcggttcgccagggagagccggcccccgagggagacagcgaggtcgcgggcgagcgagaggccgatgcccgtgcccgccccgccttcggtgtgcccgcgctcgaacagccgcgcggagtcaccgtctgccgtgccctcgtcggcgatgtccagggcgagggcgtcgtcgaggtcgcggaccgtgacgcgcacggtgccgtgtccgtggacgcgggcgttgtcgagcagcacgccgaggatctcggcgacgggcccgcccgggacgcgtacgtcgtccggcacctcgcccgtatcgcactccaggcgtcttccctcgcgggcgaacagcccgtgccaccgctcctcggtctcccgcagcagccccgtgaccggccggtctggcgcgaccggctgaggcagccccgcggagccggacagccgaaggacctcctccacggtgtggtgcagcctgcgggtggcggccagggcctcctccagcacgggacgggtgtcgtcgtgttcgagtccggcttccagggtgagctggaggccggtcagcggggtgcgcagctggtgggaggcgttggcggtgaagttgcgttcgcggagcaggagttcggccaggctgtgcagcatctcgttgtgggtgcgggcgacctggtcgatttcgccgatggcgctgggggcggcccgcgcggtcaggtcgccgccggtgacggctcggcagtgccgtgagaggtcctccaggggtgcggcaagcgcccgcgcctgccggcgggcgacgaggacggccacggtcagcgccagcacggccacgccgagcaggagcgcccagccgacgaggatgcggtcacgcacgtcctggacggcggaggagacgcggacgacgccgatgacctgctcgtcgtgggagacggggacggcggcgacgagttcaccgccccctgtcgaccgggtcaccgtgccggtcagagcgcggcgggccgtgtcgtcgccgatccgggggccgctgcccgcgcgcagccgcagctgcgggtcgtacaggcccaggcgcccgccgtccggaggcggcggcagctccaccgggtcaccggtcgcgtagtccggactcacgcggacggcgccggccagggccgcccgctccagggcgtcccgctggtccgcgtacagggagaacctaatggcgagggccagggggacggcgaggaggaccatggcgaccaggacggcggtcagggccacccgcaccacgcgctgtctcatgcccccatgatgcgggccgccgcctgcccgtacgggacccgccgcacgcttttgccgtcgtctaaccctcgccgtgcgggacgttaaccggccgccttctagcgtcggtgccatgaccacccgtccggcgcacgactgcccggtcggatcggcagagcgttccctaggcgtcttccaggagggcagcaacgatggcacgtgtacataccttcggcgtcgtcgggctcgtgctcgccgcggcggtgaccgccgggtgttccggggccacctccggctccggatctagctcaagttccagctcaagttccggtgccgctaccaccgctgcttccacgggtggctccagcagtggctcgggcagcagtccggcgcccaccgagtccaatccgcccggcgacatccccgacaaccaggcattcatcgcctaccagccgtccggcggtgcgttcaccgcgttcacggtgaaggtgcccgagggctgggcccgtaccagccagggcagcaccacggtcttcacggacaaactcaaccgcgtccagatctccgccgctgccacctcgaacgcgcccaccgtcggctcggtcgctcatcaggtcgtgccccaactgcgcggccacgtctcgaagttcgccagtccgaaggtgtccacggtgacccggaaggccggtacggccgtgctgctgacgtaccagggcgactccgccaatgatccggtcaccggcaaggtcgtgcgtgacgcgttcgagcggtacgccttctaccggcagggccacgaggtggatctcaccctgtccggcccggtgaatgccgacaacgtggacccgtggcgcatcgtcagtgactccttcacctggaagtgaggggtgaacaccatgctggtcccaccgtccgacgaagcccttaccgcgcgggagctgtaccgcttcttccgggccggtgaggaggagacgctcgcgctgcggggggtgtccctgcgggtgcggcgcggtgagacggtcgccgtggtcgggccgtccggagccggcaaatccaccctgctgtcctgcctggccggactcgacgaaccctcgggcggtgaggtgcgcgtggacggcgtacgcatcagccaccgaccggagaccgaacgggcccggctgcgcgcccaccacatcggcgtcctgctgcagaccagcaacctcgtcgcccacctcagcgtgcgcgacaacgtccgcctgacgcacagcgccgtgcgtggccggccctccgcgtccgtaggagacctgctggccgaggtggggctcgcggggcgggcacacgcgctgccccgacagctgtccggcggcgagctggcgcgcgccgggctggccgtcgcgctggccaactccccggccgtcctgctggcggacgaaccgaccggcgaactcgacggcggcaccgagcgcatgatccttcagatgctgcgcgaccgcgccgccctgggctgcgcggtgctgatcgtcacccacagcgccgaagccgtccggatcgccgaccgggtgatcgctctggacgacggcagggcccacgagaccaccacgtcccaggcccgcacacaacagcaggaggcccacgatgccgccccgtgatcacgcgataccggccggcaagcccgtgacgtcgttggacgaggtgctcgtcgactgccgcaacgcggctctcaccttcggccggggcgcgaccgccgtggtggcggtgcacggggcgaacctgtgggttcgctccgcagaccggctcgccatcgtcggcccgtccgggtcgggcaagtcgtcgctgctgcatctgctggccgggctcgagcagaccaccagcggcaccgtcacctggcccgccctggacggcccgggcggcatcgggatcgtcttccagggcgacagcctgatcgccgccctcgacgtggtcgagaacaccgcgctgccgctggtcctggccggagtgccggacggcgaggcgcatcggttggccgccgaggccctcgccctggtggacgccgccgatctggccgagcggctaccggaggagatctccggcgggcaggcacagcgcgtcgccgccgctcgcgtcctggcccagtcccctcggctgatcctcgccgacgaacccaccggccggctcgaccacaccaccggcgggcacgtcctggacgccctgctgaccgcggccgaccagacaggtgcggccctcgtcgtcaccacccacgacccggccatcgccgcgcgactcaccacccgactggccatgcgcggtggccggctgctcaccgtggacgaaccgcaggaggcgtcatgaacaccgcttgggccggcgggctggcccgccaccgcgccggacgactcctggccgccctggccggcatcgccctggccgtcgccctcgtcgccgcgctaggttcgttcctcaccgtgtccaaggcgaccatgacgcagcgcgccgtgcgctccgtcgccgtggactggcaggtcgaggtgcagcccggcgccgacccgcaggcgatgctgtccctggtgcggaaggcccccggcatccgcaccgccgtcccggtcggcttcgcccacagctccgcgttcacggcccaggtccagggcagcacgcagaccaccggccccggcatggtgctcggcctccccgacggctatcagaagctgttccccggcgggatccgcccgctgaccggcggtaccagcggcgtgctgctggcccagcagaccgcctccaacctgcatgtcgcccccggcgacaccgtcggcatccggcttcccggaacgggcgtacgccaggtccgggtggccggcgtcgtcgacctgccgcaggccgactccctgttccagaaggtcggtgcccccacccagtcgcagcccaccgcgccgcccgacaacgtcgttctgctcccctccaccaccttcacctcgctgactgcccaggcgcccgccgcaggcgttaccacgcaaatccatgccgcacgcgacgccaagctgccctccgagcccgccgccgcgttcaacaccgcgacccgcggtgcccacaacctggaggcccgcgcctcgggcgcggcgatcgtcgggaacaacctgggtgccgccctcgactccgcccgccaagacgccctctacgcacagatcctcttcctgttcctcggtgtgcccggcgcactcctggccgccgcactgaccgccgcggtcgccgcagccggtggtgaacggcgccgccaggagcaggcgttgctgcggctgcgcggactgcggccgggccggatcgccaccctgtccggcatcgaggccgggctggtgggggccggcggcgccgccgccggactcggcatcgccgccctgttgggccgtctcgccttcggatcggcctcgttcgggacgagcgcgggcacctggatcctctggtacgcccttgccttcgtgctcggcgccgtcgtggccgcgggcgccgtcctcgtccccgcactgcgcgacctgcgcggcgtgacggtcgccgacacacgcagggccgggcgccgtacaggctccgtgtggtggatgcgctacggcgtggacttcgccctgctgatcggttcctggctcatcttccgcgcctcgtccggcaaccagtacgccctcgtcctcgccccggagggcgtgcccagcatctccgtgtcgtactgggcgtttttgggcccggccctgctgtggatcggctccgcgctgctgctgtggcggctcacgctcctcgcgctcacccacggccgccgcgtcctggcccggctctcgctcccgctcgccaagaacctggcagggacaacggccgccgtcctctcccgccgcaggcggccgctggcccgctcggtggtgctgctggcactcgcggtgtctttcgcgatctccacggcgaccttcaacgccacgtacaagcagcaggccgaggtcgacgcgcggctcaccaacggcgccgacgtcaccgtgaccgagccgcccgaagcacggacgccgcccggcgccgccgcttccctcaaggtctccggcgtacgtcatgtcgaggcgctccagcaccgattcgcctacgtcggatccgacctccaggacctctacggcgtacgcccggacacgatcacctccgccacctccctccaggacgcgtacttctccggaggcaccgccggcaccctcatgcgcaagctcgcgaagcagcccgacgcgctgctggtcagcgcggagaccgtcaccgacttccagctctcacccggcgacacggtcaacctgcgcatccaggacgctcacacgaaggcgctgcgcaccgtgcccttccactacgtgggcgtcgccaaggagttcccgaccgcgccgaaggacagcttcttcgtcgccaacgcctcctacgtcgcccaggccacaggcagcgactcggtcggcgccttcctcctggacaccggcggcacccaccaaaagcagatcgccgcccacctgcgccgacagctcggcaccagtgccaccgtcagcgacctcacccagacccgcggcaccgtcggcagcagcctgactgccgtcgacctggcgggactgacccggatcgagctggccttcgcggtgctcctggccgccggggccggcggactggtcctcgcgctcggcctcgccgaacgccgccgcaccttcgccatcgccaccgtgctcggcgcgacgcgacggcaactgcgcgggatggtcctcaccgaggcgatcctcctgaccgcgggcggtctggccggcggcgcgctcatcggctgggccctctccgagatgctcgtcaaagtcctgacaggcgtgttcgaccctccgcccgccgacctcgccgtcccgggcgcctatctggcgctcaccgcgttcgccgcgaccgtggccgtactggccgccgcgctgaatggggtacgccgcgccgcccgacccgccgtcgaagaactccgggatctgtgaatgccccgcccggctctacgctgcccagcatgcgaacgcccgccgcaccggaccgcagccgctatcgcgtcctcgtcgtcgaggacgacgacaccatcggccgccatctggaaacaggactgcgcagcaacggctacaccccgacgtggagccggacaggcacgggcgccctcaccgagtccgcgcagacccagtacgacgtgctgctcctggacctgggactgcccgacatggacggtctcgacatcgcccgcaccctgcgcgcccgcctccccgacctgctgatcatcatcctcaccgcccgcacggacgacatcgacgtcatcgccggactcgacgccggagccgacgactacctggtcaaacccttcagcctgaccgtgctgctcgcccggctccgcgcccatttgcgccgccgggccatcgccgccccgccgcagcagccgatccggctcggcgacctcgtcctcgacgtcacggcccgccggtgcacactccacgaccgtgaagtcgatctccgccccaaggagttcgagctgctcgccgtactcgcccggcacgccggagaggccgtgtcccgcgaggtgctgatggctgaggtctgggacgagaactggttcggccccaccaagaccctcgacgtcaccatggccggcctgcgccgccgcctggccgacgctgccaacgcatccccgatccctgcggcgctaccgcggatctccaccctgcgcgggcacggttaccgccttgagccccacgcggtgccgcccgtctgaggctgacggcagcggcctggccatcgcccggagcgtcacccacgccacggagacatcgccatggagtcgcagggcccggcaagggtgcgccgttcacggtgcgcatcccgctgacggcatcggtcaggctcagagcacgaaacgccgggccaacagccccagcaccagcaggccgggcaccagaggcaggcagccggtaaccggacaccgccgacaccgccacgaatccagacgcgcctgccgcggtgagcgcaagcgccagcgccgcgtccagcgaacccagcccgccaggggtgggcagtagcgccgccgctccactcgcaacgaggtacgccaacagcacccgggcgaaggggaagcgggaccccggaatcgacagacgcggggcatggggtgaggccagcagcagcacggcgaccaggccggcgcgcacgatgccaccggcagcggccttgaccgcgagagcggtcgccgagcgcgcggtgcctgggtccgcctccgcgccaagggctggccgattattggcagggaccgatatacaggagtcggaagtagtgccggaacagaacccggctagccactctgccgaactgagggtctggcggcaccagaagggcggcgctggtcgggctgctgggcctctacatggcgtaccggagcaggaacggaacctgccaggcgatgacgatgtcggccgtttgccgggcggcgccccccggggacgcccagtgaggcgctgcccgtccttgatcagccgtcttggccctgcggtccgacgaactgcatggagaggtgggccggatcgctcagcggctcaggcagacgccagcttccggatgcgcggatggttctccaacgcccaccgcacggtcttcggtgggcgtccgagcagggtttccagctggtcggtgacgccgcggtatccgccgccgcccatcagccgggtcagagtcttcaggtgctccgcggtgtgtgggagcgcgcccaggacggtgtcgacgtaggtctcgttccaggtttcgacgtcttcgggaacgtaagtgacctggcgtcccagcgcggccgcgtagtcctccgcgaacccgtgcatgtccttcagctccgggccgttgaggtcataggacttcgagatgtgcggagccgggtccgccaggatcttcacgcacagctccgccacgtcgtaacccgcgatgggcgcgagccggtggtggccgaagggcaggcgcagttcaccgttggccagcggctccagcgccagccaggtcatcagggggttctcgacgaacatggccgcccgtatgttgacggtcgggaggccggaccagtccagcacctgctcggcgacccagtgggcgcgctgctgcggcgaccagttggcgacgagtccgccgagccacgcacgccgctcttcctccggcgcggtcatcttctcgaacgtcatgaacgactgctcgtactcggagatgttgacgaagacctcgatgtcgccctgggcccgtgccgcggcggccatcaggctgacggcgtcggtgtagtacggcgacaggctcatgctgaagtagatgcggcggacgcccttcagtgcggcgctcacgtcggcgatggtgagcaggtcaccgacgaagacctcggccccggcctggcggagcgcgtgcgcacgttcgtcgtcctggcgcacgaacgcgcgcaccgggtgcccttgttcgagcagcatgtcgaccgtcgttcggctcacaccgccgacttcgccggcggcaccggtgatcaggatggggttgcgctctgacatcaatgtgtcctctgtctggtggggggagtcagctgttgagaaagccacgaggcgggtgccgcgtaacgtcatcgaggcgcggagccgtcgatgcgggtgaggaagtcgaggagtgcggcgttgacctcgacgggacgctcctgctgtgtccagtggccgcagcccggcagcaccaccgggccctgcaactgaggcgcgacagcgctcagcgggttgcccgggccgccctggccacggaagatctcgctcagcgagggacccccgtccgggccgcgcaatgaggtgaccatgtcgcggtctcccacgacgtacagcgcggggacgtcgattccgcgcccccggaacggcgcgagcagttcgttgttgcgttcgatgttccggtaccagttgaaggctccggtgaacgcccgctcgccgtgcagggcgaagtcctcggcgtacgcctggatgtcctcctccgtcagccaggccggaagagcgggcgattccggcatgatgtccaggaggcccagaccgtcgggtatgaccaacgggcttggttcccggccgagcggattgtcgcccgaggcaccgaccaggaagcggcggaaggagttcgggatgtccttggcgaactccgcgtcggcaactcccggctgctggaagtagacctggtagaagccctcgccgtactgagtgcgggtgatcgagggcgggaccatcccgccgggcagaatgggcggaatgctgagcccggccaccgcgcggaccttgtccggccgcagcatcgccgtggtccaggcgacgggtgcaccccagtcatgacccacgacgaccgcctgctcctcccccagctcctcgatcaggccgatcacgtcgccgacgaggtggagcagggtgtacgacgccacgtccggcggctgctcgctacgggcgtagccgcgctggtcaggggcgacgacccggtatccggccgccgccagcgccccgaactggtggcgccaggagtaccagctctccggccagccgtgcagcagcaggaccagcggcccctgcccctgctcggcgatgtgcagcctgaccccgttcacgtcaacgaaacggtgagtgagcgaaccttccacagcaacctccttgaatgcgtgctaatgcttcagctgggcgtacatgtcttccaggtcggcagacagctgcgacttgacccagcgggtgatgtcgtcggccagcacctcgtgcgctcccgcctcgatgccgtcgagtgcggccacggcgatgtcgcgggggtcggccttgggcgcgtcgacgcccgaggtcatttccgtgtccacgtaggccatgtggagcccggtcaccgcgatgccgcgcggctgcaactccaggcgcagggagttggtctgcgaccacagggcggccttggaggcgccgtagggcgtgccgtccgccagccaggacagagcggagtgggcgttgaggatgtggcccccaccgttgcgctcgatgaccggcacgaaggcccgggtgaccagcagcggcccgtagaagttggtctccagatcccggcgcacgtcctccatcggggagtcgaggtacgaagcgcggacggaggcgccggcgttgttgatcagaatggtgacgtcctgggcctgctcggcggccgccgccacagatgccgggtcagtggcctccagcgccagcggaacggcatcggggtgagtcaccgtgcgcgggtcacgggccgtggcgtagaccttgccggccccgcgcgcatagagcgcctcgaccagcatcttgccgatgccgcggctgcctccggtgacgaagacgctggcgcccttgattgctgtcatgactacctccacgaagatgaaaaccgatcggtttcactaccgtaaaccgatcggtttcgtcatgcaagtcgggttgaggaaggtgactgcggcgcgcggtatcgaggggggccgggcggcgctcaggcttcaagggctggccagccgcgtgtccatcggtgaaatcggtactcgccgggcgcaggccggtggggccgcgagcctgccagcagggatcgacgtggcctggctggacctcaggtggggttcagcggagtgacgcgaggagtggcgttcccgtacggctcggtgtcgccgacatgctcggccgcgcgttccgagtcggcggccaagggcggtcaactgccggcggcgcaaggacagcccaggtacggcaggcaggttggcgaggctcgcaacgacagggaaggcaggcccgacggccccggcgacctctgtggcgacgcgacctcgcgacgaaagacccagtccccgggggctggcgcgcggccccatcggacggatcgcgcattctgcgacttccctccgattgcagggaagcaggggctgaggccatgggtgctcctccggctgccggagtcgggcatcaatccgaaagagcgcttcggtcgccgatcctgctcgaagatagggcggatcagtgcatgtctgcggcatcgagcagggtggtcagggtgggcacgatgagcccggtcagattgtcggcgccgatccccgctcgggcgctggcgccgtcgaagaccaggatgagctgccgggccagcaggtcgggatcgcttgccccaccccgttcggcctcggaacggaaaaaggccatcaggtccgctttgatctggtaggccacccggctcgcggggtgggcctgatccttgagctcgatctgcacagccaggtaccggcagccttggaagtcgggcgcacccgcctgcgactccacccgctcgaagacgtacaggatccgctcgcggggggaacggccatcgtccgccgggggcagggccttcgccacgaaggcagcggaacgctccttcaggctcgccgccagcagttcatccttgctctcgaacaactggtacatggagcgcttcgacacccccgctgccttgcacagcgcctcgacgccgatgccgacgccgtcgcggtaggtgagcgcggccgcggcctccagcagccgctcccggggactttgcttcacttcggtagtcataccgcgaggttaactcgaatcggacgaaaaagaaaccgatcggtttccgtggagtgtcgggggacactcccgccgccggtcggacgcgtacaggccgctcagaggctcggcgacggtcttgggggagagaccgtcgccgagccctgatggtgcacgcgcctctcgtccccacggggtgacgcacaccggggccactccgagtgatggccccgtcctgggtgagccgcgttccgctacgccggggcagcggtcttcgcgggctccgtctcggcggggatgcggtgcagccccttgcggtcgtaccagcccgtcatgccgaagccgaagagggcggctgccgtgaggccgacggccatcatgacccagccccgggtcaggccggcgtcggcctgggcgtcgtagtagaggatcgagcggatgccgccggtgatctgccgcagcggttcgaactccgccaggaagcggtagaagccgggcagcgcctgaagcggcgtggtggcgccggccgtcggcaccgccatcccgatgaagaccagcgtgaccaccagcatgccgggcgtgccgaagacggcaaggagggtgagcgcaccgatcccggagaccgcgatggcgcacaccgagaacagccacagcagcggtaggtgggcggcgtccatgcccatgaggccgatcgcgcccaccatgaccaaggttcccatcagcaaggacagcccggccatgagagtgctgctgatggcgagggtctgcacccgggtcgcccggatcagcgggcggtgcaggcgcagtgggcccatgtcgttgtgggtgtagcccagagcgtggtcgacctggccgctgatgacgttggcggaaagcatgccgacgaccaccaggaccagcgcgtagtagaacgccgtcaggcccagaccgctgtgcgagtcgagcggatggccgtcctcgacggcgacggcggccgggtcggccagcaggacgcgtgccgcggcgggtagcttcgcctgtccggtcccgccttggggcgtgagctccttgcccacctggagcgaggcgttttcggccgcctgtgtcgtcgcagtccgggccaggctggatcccacgctgccggcggactggttggtcagcaccgtcagcgtcggacgggtcgggaccccggtagtcgcggcaccggtgagtgcggtggtggcggaggtgaagtcggcggggacgacgagcgcgccgtacagcttgcccttgccgagttcctccttcatctccttctcgtccatcaccttccagtcgatcttgcccccgctcgcggtggacttcttgatcgactcggtgatccgagcccccaggttgacctgctcgccgccgacagcggcccccttgtcggcgttgaccaggccgacgggcagattcttcatgtgatcgacgggatcgatgttggccccgacgtagaacacggtgaacagcagcgcgaggacgcccgtgatgacgccgttggcgatccacaggggtttggcacgcaggacgcggaacgggtgaatcccactcatgacttactccggtctcggacaacacgctcatatccggagaagggcggacagcttcattgcggtccggtgaccctcggaacgctcaacctcggcgcacacggccgtcgacgcggaaccggggatacagcaccccgccgggactccggctgatgaaaccggtcggtttcaagtccatcgtaaaccgatcagtttacaaactccaagtccaggcgtcgcgacggcagcgaggaccgaagagcctcgggtgaaggcgcttcggcctctcgggagggttcagcccgtggcgacggggacccgctcgccggcggtgtcgtcggccggcatgtcggtctccttgatgccgaaccggtcgtagaagcgggcgagtgggcccggagcccaccaggccgctctgcccaacagcctcatgacggccgttcccagcaggatgcgcaccaccagcacgtccaccaggaccgcgaacaccatgccgacaccgaagagcttgatggtcagcacatcgctcatcccgatcgccgcgagcggcacgcacatcagcagcgccgcgctcacgaccaggcggccgatggactgcagcccgctcgccacggcttccgtgctgtcacctgacttgtcgtactgctcccgcatccgggacaccaggaacacctcgtagtccatggagagtccgaagatcagcgcgaaaagcatgatcggcatgttgggctcgatgttgcccgtcggatcgaagccgagcaggttgtgcagatggccgtcctggaagatccagaccaggacgccgaaggtcgcggtcagcgacagcatgttcatcgcgatggccttcagcggcagcagcactgagccgaacgcgaggaacagcaggaggtacgtcatcaccgcgatgtagagcagcatccacggcagggtctcgcccagtgcgtccagggtgtcgtcgtagaccgccgactcgccgccgaagtacgcgcgggcgcccggcggttcggggacgtccttgagccggttcaccaggtcgcgcgcgtggggcgagatgggattgccgtcgtaggtgaccgacacccgggccgtggtgccctcgactccggtgatccgggcgctcgtggcgccctcggtggcgccgagccgctcggcgtacgccttcagcgccgcgccctggtccttcgaggtgccgtcggacttcagcacgagcagggagtcgatggacttcaccgcgtcgccgtcgaagtcgtgctccatggcgtcgaagacctggcggccctcggaactgctccgcagttgctgcgcgttgatggaaccgaactcgatcttcgagaacggcagggcgagcgtcagcagcaggcccgccgcgcccaccaccacaacccgccgccgccgcatcaggccgtgcccgaaccggtaccaggcaccctcccctgccgccgtcggccgccctgccttcttgcggcgcagcgggaaggcgttgaccttcggtcccatgacggcgagcagggcgggcagcgcgaccagtgagaagagcaccgccagcaggaccgcggccacaccgccgtacgacatcgacttcaggaacgtcgacgggaagagggtcaggccggccagcgccgccgcgaccgtggtgccggagaccatcacggtgcgcccggccgtggcgagggtgcgcccgatcgccgcttcgccggtgtagccggccgccagttcctcgcggtagcggctgacgatcagcaggccgtagtcgatggcgaccgcgagacccaggatggtgaccaggctcatggagaacacggacacgtcggtgatgttggcgatggtccgcaggacggccatcgaaccgaggatggagagcacgccgacgagcagcgggaggaaggccgcggtgagaccgccgaacacgaccagcaggagcaggaagagcacgggggccgagatgatttccgcgattctcaggtcgtgttcgatcttctcactggcctggtggccggtgggcaccgttccgccctgcagcgtctgaaggccgggtgccgggatcttgtccttgaccgcctcgtacgcgtcctccttggccttctcgctgctgccgtggaggttcagggcaacgtaggtggcgtgccggtcgtggctgacctgcgtcggcatcctggtcgtccagaagtccaggtagccggtcacctccgacttcggcagggacgccaactgctggacgaccgcctgctgaaaggacgggtcgtcgacggtgcggtcctcgtcccggtagacgatcaccgcgtcgggtgtccgctgcgggaacgccttctcggcgatcttggcagcgcgcacgctgtccgagccggggtcctggaagccgagcggtgtcagcgagccgaagactccggcaccgtaggccccggacaggacggcgaacagcagggtcagtatcagcaccggctttcgcctgcggtacagcagacgcccaaacccctcaaacatgacttctcctagatcgttagccggcgccgggcaggaccgtccgaaagtcggcgccaaacgaaccgtaacagtgtttttattgctcgacgcaacgcggttgcacacctctcatccggagaggggtcgagcgaccctgccctgaactgccgatatgcaagaggatctcgttcggaagtggcgggtcctgacgtggggcgcagcggacgacagcaagccaaggcgataccgagaagcattcgtaacggcgttgcaatacgatggcgccatggccaggctcaagacacatgacgaagcactccggctccggctcctgcaccgcgcggccgccacggtcttcgaccgcggcacggccgcgctgagcctgcgacagctcgctgcggacgtgaagacctcgaccacggcggtctactcactgttcggcaacaaggcgggtctgctcaggagcctgtacgaggaggccgcgcggctcttcgccgcacgcctggcagccatccgtcccacggacgacccggccggcgacgtgatccgacttgggctcgtctatcgcgaatacgccatcgccaacccgcatctctacgcgatcctcttctccgaccgcagcgttcagtgcccgtccgagtcggagccggagaggccgcgtgaggccatcgagacctaccggcccctcgtcgacgccgtgcggcgcggacagcaggcagggcagttcggttcggagtccgacccggaggtcatcgcgctgtcggtctggggaacggcccatggcctggtgtccctggtgctgtcggggaacgagccgcccgggctcgcggtcgccgactgctatgagcgggccctgggggtattggtagcggggtggcgagtgagcgagggggaggttcaggggttcgcggacgtgccgtgagcccggagccggtaccgctccgagcctgaacgtacggttcagcgcgactctttcgggtcgcgtccctcgaggtgggacctacgaccagaacggcttctccggccaccccgatcacatccaggcgaaccggatcacgatggcagcgctctgtcgctgaccgggatgacgtcgaaggtgtactggacgacggcgccgcgctcgatgatgaagaagttcgggcagatcatgcgcgatttgggcgcggaccgggaggagccgggtccgtccgaggccggagaggggcccgaaaccggcctgcccgaccaggaaatcaccacgtgggtggacaccactgagttcggcagccagaagttcgacgcgctggccgcgcacgccagccagggtcagaacatcttcttcctgcggaggagcaaggagaggttcactcagctcatgagcgtggagacgtccgtccgggtcctcgacaccaccggcgcgcccccgcccgagaacgacctcttcgccggcctgcgctgagctccagtcaccgaccgtccttcggacacacggagaaccgcagcctgcacacgccgcaccccgagcgacgttgtcggagccttcttcaaggcggacgacgcgcgtgctgtcctcgttgaaggccaggcccctcggcgccggccacaccgcgagctgctgcttgacctgtcgggcccgtccgcacaaagccatcagatggtcggcataacggatcgccaccgggtgcccggctcaaacctaccggcctgcctcatcccatcaggaaggtatgggcccccggctgcttcatccagcccatgcggggcgacgttcaacagcgtcgagctgacaccccgccttgtggagccctctcctccgaccaggcggccgcctgacgcgggccggagaggtcacacgagcctgaccggcccggcgtcgatcggcaggcggaccaggagatagggcttgcggcgcaggtccttgccctcgtggaagggcgagagccggttgagctggttggcgatggcgtacaggtgccggtccgaggcgacggacagggtgtcgacccagagcagatcgcgtccctgggcgagggtccggtaggtgccgttcgggctcctgcgccagatcgcgttgtgttcgaggtcgccgccgtagagccgtcccttgtcgtcgctctccaggccgtcggccatcggcttgaaccccaggtcctcgaccgtcgccgccacctcggcgtccgtggcgtccgggttggcgagggcgtcggtggacacgctgtgcagccggcggctggacagcgggcagtagtagaggcgcgtgccgtcggcgctgagagcgatgccgtcggagccggtctcgtagtacgtgggctcgccgcccgcggggcggaccatgaagggctcaccatcgatgaccggaaggaaccgctcgtccgggagtgccgaggggtgcccggtcagtcgccgccaggagcggcccgtggcgaggtcgaccacgacaatgccgttggagccgcccgagtcggtgatgaacgccgtgccttcggcgccgcgccgcaggtcgaagcgcacgtcgttgaggtagctgttcgccggcaccacctcgggcgggaagaggatcttccgtacgatccggtccgtgcgcaggtcgaccgccacgagcttgggaccgccgtaggaggacccggcgaaccccgggcttccggtgtcgagaatccacagccggtcggccccatcgacgacgacgctctgcaccgactggaagtgcccggccaggtctgaggcgtcctgacggttcacctcggcgtcggggtaggccaccggcttcccgccgcgcagttcggcgacggtgaacggaacgtcgtcgccccagcggggaaagttgacgaagatccggcctcggcgcgagacggtgacacccgtcggcatcgcaccccagaagcgggcaacgaccgcgtagtgaacggctgttgaaccggagggggaggaggagtaggcgtaggcgtaggcgggcccggcgagttgggtggcggccagcgaagcggtggtcgccgcaaggaacgtacgtcggttcatcgaagcgtctcctggaggtcaacttgctggaaggcgcggcgagttgccgcatcacctcggcgcgtgggggaattggccggacgtctgccgtggccggtggaggacggtgcctccagcagccgctctcggggagtcggcttcgcccgcctggtcagggcgagccggagtccacctggacggcaggtacctcgtacgttcctgcgacctgaagtcgtccgccgaggacatcgcctgcggctgccgccaactcctggaaggggaacggggtcaaacggccggtggatctggtgctctcagggctgccgggctgccgggcgggtcttcgcgaccatgctgcggtcccccgaggagaccatcgcgtgaatgggtacggtgctgacgctcatgagcgtcgcaaggccccggcggccctgctggcgggcgagcgccggacccatgaggtgcatcagggcggtgagggccggcatcggacgcccgaagagcgtgatttccgtgatgcgtgcttggttgtcgagccgcagcatctgcacctcctcgaacgactgggaacccacccgcgcccggtagaccagggcgtaggtgtcgccctcgccggtctgggtgtggtaatggacgtccttgaccgccgcgaacgccgaggtcaggaagtcacgcagctggtcagatccctcgaagcggaactggtcggtgagaggcgagctgagcacgacgtccgggctcaggcacgcgaccgcggcgtcgacatcaccgcgttcctcggcggagcgccagcgcgcgatggtagtagcggcggagtccagggtctcggacacgggtctctcccggtatcaacggcacgaacgggtttgtgggtcgcgggatgcgcgggtggcagatgtcagccggtgagcttgttcatgctgcggatctgcttgtccaggacccaggcgggaacgaagcggagcatgcgcgcgcgtccggccatcgggccagcggcgtagcgcagtttcggcttggtgtcggtggctgccgtgacgatcgccttggcgaccacggcggggtcgtcgccggccttgatcgcctccgtcatcaggcggtcgaagacgtgccgctggtcggcgtaggtctgcagggggctgtcgggcttggcgctgttggcctcgaatccggtgttggtgtaggcgggttcgaccaggagcgagcgaaccccgtactggcggacctcgtggtccagggactgcgagtagccctcgatcgcgtgcttggacgcgccgtagacggccatgtagggagcggggatgaagccctgcacggacgagaggttgatgatgcgtccgcgcccccgggcacgcatgtgcggcaggacctccttgaccatgcgcatgaccccgaagacgttgatgtcgaagacgccctgggcctgcgcgagtgaggtttcctcgaccgcgccgatcgagccgacgccggcgttgttgaccaggacgtcgatccgcccgaaccgctcgatcacctgctggaccacggcggtgaccaacttgtcactgaccacgtcgaggtcgaagaacgtcacaccctggagcggggtgacgcgtgaggtgtcgcggcccgtgccggccacctcgaaacccgccgcgaccagcgcgagcgcggtctgcttgccgataccggaggacgcacccgtcaccagggccaccggccgatttgtcgtcatcatgcactcccgaagccatctgggaaaccggccggtttccccttgacctcactgtaaaccgatcggtttccactgcgcaagctcaagcacggaactgatcccgggccgcgtcgccggccggcttcaagtcgagctgaccgacgcccgccggcatggcggcgcgcgccggatgagcaggcgggagagacgcgacagcaccatcagcgcgctgcgatcgcgagttcgggcccaagggctgctacggcatttccgccgaggcgattgccaggcaggccggtgccacgcagccgtacctcttccgactcttcccgggcgagaaggcgaccgccgccaccttgacgcggagcacggaagaacgccctcctggcgttcgacagatggccaaggacgggcggcacgagcgggcctcacatgccatgagcagctcaatggggatcggatacgtgcggctggtctcggcacaccccgaaaacgctgcagatgcaggtacggggatgtctggtcgcggcagccgccaggcacaccaagcagcagaagccctcggcggcgtcgggtgggacaggcgcgagcccgatgccgtcgacgataatcaccagctgggcgcagtgctcgattctggcgaatgcgtccaccgcgcgaatggacagtgactgcggtcgaggacgcaggcacctagcgggtttgggcagctgcgggcgcccagcgatagcggcagggcctgtctggtgagcagggggtgtgggctgccgtctggtgcagaagctcctgagggaatccggcctgcctgatcagagctgatcgctgatggctcggtaggccgcgatgtacagggtgtggcacaggtcgatcagttcttcgacggtggccttctggtggccgagcgtccagtccacgagcagttcgttgactccgccgaccagactcatcgcggtcatggcgagccggctggaggaggcttccgggtcagatagcggtccgacgacggcggcgaccatcgcggcgaattcgtgcaagacgtcacggcgccgcacttcgaggcgggggctggcgcccacgacctcgatgagcaccaggcgggccttgcgtgcgtcgccggccagtgtgcggatgaagacctcgagtccggcgcgcaactgggcgtcgacatcgggtgcggcagcggctgcggcctgcgcggtctcggcgatgatcgtagtgatcagctcgtcgtagaccccggcgagaaggtcttcgcggtcgcggaacgactcgtagaagtagcgctcggtcagtccggcgtgcgagcacacctgcttgacggaggccgaggcatatccggctgtgccgaacaggtcgaggcccgcctggatgaggcgggtgcggcgctcctgctgtcgctgcgccgcgtcgcgtccgccgtagcgccgcccggcggtctgtgtgccggtcatttctccccttcgcagaggtgttgacaccggtgtgctccgaactgacactctagcttgtcagttcatctgacatggtgtcgtgtcagacgagcgcgaggtccgccggccgctcggcgctcatgctcagggcaagaaaggggctcgaccgtggcagcaccgcccaaacacccgaatacgtccagccggagagaccacgacaagctcgcccgcacacaaccgctgaccggccgagtgatcgcggtcaccggggcgggccgcggaatcgggcgtgccgtcgcagcccggctcgccgcggccggagccgccgtggcgatcggcgatctcgacacgcggctcgccacggaggcggccggtgccctcagcacgcgtcccggtggccggctgctcgggctgcctctcgacgtcaccgatacaccttccttcgaagacttcctgcgcaccgtcgagacccggctgggaccgatcgacgtactcatcaacaacgccggaatcatgtgggtgggccccttcgcggaagaaccggaggaagccgccctgcgccagttcgacgtcaacgtccacggcgtactgcgcgggatgaaactcgtgatcccgggaatgcggaaacgcggtcgcggccacgtggtgaacatcgcctccgccgccagcaaggtcgccccggccggcgaggcgacctacgcggcgacgaagcacgcactccacggctacagcacagccgtccgcgccgaactgcgcggcaccggcgtgcacatgtccctggtgatgcccggagtcgtggacaccgagctggccgtgggcaccgcgaccggacccacccgacgcctgacgacggatcaggtggccgacgcggtgctcgacgtcgtgctgcgcccgcggttcgaggtcttcgttccccgccaggtagccgccctgacccgcttggccgcgctgctgccgggccgagcccgcgacgccctgcatcacctcctcgtccccaaccagctcgccgccctgtccgaccggtcggtccgcgcggcctacgagcagcgcacccgcaccgcccgccaccccgaaagttgagcccgtgaccaccacgcccaagccggcgcccagcgcgaagaaggcccaggacgccgccgctccgcgccccatccccgaattcgaaggcgtccacgacgtatggccccgcggcgaccggctgagcgccgtgcgcagcgccgcggccacctaccgggagcggttcgtccagcagggccgcatccacgccgtccgcagtttcgacatcgccgccgccccgtacccgacccggttcggcttccacggcgccgcgctcgccgtcaacccgttcgtgagcatcgtcaaccggatgctcgtcgtgcagttcgacggcttcgacggcgagccgaaaacactggtgtgggagccgaccgtcgccgccggaacggctcaagcgccgttctacgcacagctcaagcgtctggcgggggactttctcaccgagcacgtcttcgcccgcttctaccaggacccgaacaccgtcctgccctcctgcggtctgcgacccgaggacgtggacttcgtcagcttcgaccacctgcacgtccaggacgtgcgcatgatcatgggaagtacccgcaccattcccggcgaacgggcgccccgcgaagcgctgttcccgcgcgcccggctgctggtacaccgcagggagctgggcaccttcgaatcgacgcatccgatgcagtgggcctggtacgtcgacggaggcatggacggcgtaccgcccgagcgcgtcaccgccttcgacggcgatgtcgaactcggcgtcggcgtcagcctgctgtggacccccggccatacggacggcaaccactccctggtgctgaacacccctgacggcgtgtgggtctcctccgagaacggcatctcggccgacaactggcagcccgagctctcccgcatccccggggtgcgccgccacgccgcgttctacggccatgaggtggtgcccaacgccaacaccctggaggactccctcaaccagtacgactccatggtcaaggagaagaccctcgccgaccccagccggcgcgatccgcgctggctgcagatcctgccctcctcggagctggcccccttcaagcggcactggccggtgcggcccagcttcctccacggcggtctgaactacggcgaactgacccctgccggtggtcgccgatgaccggcccggccgcccgccggatcgccgccgacggcgtggagctggccgcctaccagtggggaacgtccaccgctcctgcggtggtgctggtccacggctatccggacaccagcgccgtctggcaccccgtcgccgaccgcctggctgaccacttccacgtcaccgccttcgacgtacggggagccggtgcctcccaccggccaaggggtctgcgcgcctaccggatgtcccgaatggaagccgacctggaggcggttctcgacgccgtgagccccgaccgcccggtgcacctggtcggacacgactggggatcgatccactcctgggaatcggtcaccggcacccgcctggccgggcggatcgcctcgttcacctccatctccggaccctgcctggaccacgtaggccacctgatccgggcccgcctccgaccgcggcacccggatctgccgaaggtgctgaggcaggccgcacgatcctggtacatcgcctacttccatctcccgctcctgcccgccctgacctggagagcactgggacaccgctggcgcgccttcctcaccggctcccaaggtgtgcccgggcacaccccctaccccgcgccgacgctggcccgcgacgccgtgtccggcaccgcgctgtaccgcgccaacatgctgccccgcctgctgcgcccccgggaccggccgaccaccgtcccggttcagctcatcatccccacgcgcgacttctgcgtcaccccggtgctgtcgtacggagtggagcactggacggggcagatacaacggcgcccgatcgacgccgggcactgggcacagctcagccaccccgaggaggtcgcgtcccggatcgcggaattcgcccaccgcatcgaagacggctcccgccgcactccggaccgcaccgcgcacccgatctgacagcccaacagaccggcagggccggcagtactggacgactgcctgaccacccttccgcacacaccgatcgccgacggaggaggaacccgtcatgttccgagccgcacatgcccacccggagcgtccgtccgagcccatcgaccaccacgacctggtgctgcaaccccgggacgtcaccttcgactggagcaccaccccgctgcactggctgccgggtgagcccttcgccacccacaccttcgatgtgctccacctcatgctccccgagctcgaacgctggttcgtgcgcaccttcgagcaggccctgccattgatcaccgacgaccggctgcgcgaggacgtacgcggcttcatcggccaggaagcgatgcacgccgaggcgcaccaggaggtcctggagcacctgctcgccaaagggctggacccggccccgtacacccgccagtccgaatggattttccgaagggtgctcggagaccggccggaactgacgccggccgccacccacgcgcacctcctccaacggctcgccctcatagcggccttcgagcacttcaccgcgtacatgggtcactggattctcagcaacgggcacctggaccgggccggcgcggaccccgcgatgctcgatctgttccgctggcacggcgcggaggaggtcgaacaccgctcggtcgcgttcgacctgctggtgcacctcgatccccgctaccggcgccgagtgaccggcatgctcgtcaccgctccggtgctgacccggctgtggatccgcggagtccgcttcctgatgagcgccgaccccgaactcgacgaccgggtcgaggtccgcttccgcgactacctggccgccgcccgcaaggacctgttgcccccgccggtctcgttcgcccgctcggtactgcgctacttccgccccggctaccacccgacccaggagggctcgacccagcaggcggtcgcctacctggcgacgtcccccgctgcccgagcggccgcccaatgacccggcaaccagtgaggcctcccatggacaccagcacacccctcacccggccgccggacctgtacggccgaccgcgcagcgactccttcatgcagaagctggctgctctcagcgaccacgcagtcacgcgcctcgcgcggcgcagcactccacccaggcacccgcaggccgccgagacgcccgcgatccgggaactggtggtcgccaccaagcaccaagaggccgaggatgtcgtctccctgcggctcgcagcacccgacgggggaatactcccgccctggcagcccggcgcccacatcgaactgcacctgccctccggccgcaagcggcagtactccctgtgcggcgaccctgccgaccggcaccggtaccgcatcgcggtgcgccgcatcgccaacggccaaggcggttcggccgaggtacacgacgccctctcagacggtatgcgggtcgccatcaccgggccccggaacgccttccccttcgccgccgaagcatccatcctgctcatcgcgggcggcatcggaatcaccccgatcctgccgatggcccgggaagccgcccgacgcggcctggactggaggctcgtgcacaccggccgcagccgcggctcgatgcccttcgcggcagagctcgccgaactcacggccgcagcccccggccgggtcaccatccgtcctgacgacgagtccggcgcgcccgaagcagccgatctgctgagcttgagcccggcgacgggtgcggtgtactgctgcggacccgcgccaatgatcgacggcgttcggcgcgcgttcggtgacagccgcgcgtcagccctgcacttcgagcgtttcgccccggccccgatcacggacggccgtcccttcgaacttcaactgggcgagaccggacgggtcctgccagtgccgtacgaccgctccgccctggatgttcttcacgacgccctgccagacctgccgttctcctgccgccagggattttgcggcacttgccgggtacaggtggcccatggccatgtcgatcaccgtgaccgccggctcaccgccaccgaacgtgcggccggcgccatgctgccctgcgtctcgcgcgcaccggaaggagagcggttggtgctggagctgtgagtgggggccgcgcccatagagcgcggccgtcgccgcgaggaacctcagcggcaacgttgatacccgccccttggcgcgccccaccgcctggactaccgtccacgaccgcccgcacaccgggcactccgcatgctctccccgctgcatcgcagccacccgctgccgggcccgctcaagcctccgccaccatcgtctgcggcagcggatcaccacactcccgcgcggtgtcctcccaccatgccagtcgtcacttgtccgagtcacttcggcgggcaatttcagcagcgtatgaagtcttagccgttctcttggcccagctggtagcggttgaggtactgaggccgagaaggcggttgacgactgcggctgggacttcggcggtcaggtcgcggatagccgccgtgcggctgggcaaggaccggatacccagccgcttgagtcgggcagcgagagtgatatggctgaggtgctggcccggacggattccggggaacagccaatgagcgtcaatctgcccgatctggccgtcgcggcggcgatcagccgcgatctgctgaataaggttgcccagttcgggagatagttcaagaggctccttgccgaggcgcaagaggacgctcttctcgcgcacgacgacgtgatcggcagtgagacggatgatcacgctgaaaggctgcgcgtagagaagactcagcaggccggcaacacggtcgcgtgcgtcgagctggtcgtcgccgaggagccggtgggcgatctctcttcgttcgtcctcgtcgagagcttgggtcggagagttcttgagacgcgccgggatgctgatgtttgtcgctcgcttggtgcggacggcccagagaaccaggtcacgagcatattgccgtgtagtggggccgccttccagccagcggtcgagatcacgctggccgacagcctcaagattcaggccctcggctcgcagccaggccaggaagccgaccgctgccttgacgctgcggcgggcggacaccgcctggccagcggtgatgggcttgcgacgggagtacttacgcagacgagtcaggtgggtccaggtggcaaatgcctggatggtgtggcggtcggagagatctgcaatggcagcgacagcggcggcgatccatcgctctgccgcgaccagttgttcgtcgcgtcgcggcagggcgccggcagcgacgaggatggcccgaaggtgttcgacggccttgtctgttcgggcatcgagtgattcatggtcgagggagcattctgcggtggctatctcgcggagtaccgagactgctgtgttccgcttttgtagccagtccaggacgcggacgtgattgctggccatcagggtcgagtgaagttgcatgagtggggctgcgacggctccgtcagggcctgccagcaacgcggtgagttcctcattgcaggcgcatcgatggcagaggccgtggtgccggagtcgttcgaccgtgccgcagcgggtgcaggccttgaaggagacggggttcttcttgaagcaggtctcgcaaagggggccgttggcggttcgggccttgacgggcatggtgcggccgcagtccaggcagggttctcgcaaacgcgtgcagttttcgcagcgtggcatgccgccggcgacgccgaagcacgggcgggcgtgcccgcagagcaggcagattgcgacgggtggccggtagcaggtgtcacagagggggccggtcgggctgtttcgtctgataatcggccggagtcggccgcatccggagcattcttcatggttgatcgggtcggtccggtcacagtggttgcagatggattgtccgtcggggctgcggcgggcgacgggagagcggcgcttacaacgagagcagttgacggccttgcgggtgttgtagcaggtcgggcagaccctgacatctcccagggtgttgcggagcgtcacgctggtgcggccgcagtgggggcagggcgggcggacgatggcttgcgctccggcgtcccggagggcatcgatcagcgcgatgaccttgggggttccgtggccggcgttcccggtcagcattccgggccggtcctccaggtcccaggccagccgccggacgtagtggggacggccgcgggtaatggtggtgatgatctggcggacggtctctgccgggaccgtggggtcgacagtggcaatgtgatcgcagatccgctgagcccagtcgatattgtccttcggctggcagctgctgcagagtccttcgccattgcggcccgtgtaacggatgacccggggcaatccgcagtcggcgcagggctgttgctgggctcgtgcggtggcgtcgcagtaggcgcagacgcggagtttccctcgtcgctgcgggaggggttcgggcttgccgcagccggcgcagaggggaacggcgacttggcgggcgccgtgtgccaggagcttgtggatcagccgttcgacggaacgagagccttcggggcgcctggacgtcagcagtgcgggatcggccgtcaatgtttttgccaggctccggcgtgcggtccggctgggggcggcttgcttcaccgcatcccggatttgctccacagtcagatcaggctcgacccgcgcgaccatgtccacgatggtgccgcagggatcagagaggatccggtcgggctgggtcacggctctgaccgggggacgatccgggcccgcttggggcggaacgacccgacgctggtgtcggcgtcgccgactgcacgcttcggcttggcagccgaggaggccgaggctactggctcgatgaggtcgtccatcgagcagtccaggatgtccagcaaggccatgagaactttcaggctcagtcgctcgggtcgctcagtcaccagccggtagacctggctggaggacaagtcgatgccgcgttcggccagcagaggttgcagggagatcgtggaaaacatgccgcgggtcgccatgacctcgcgcagtttccaccggtagtcgagctttgccgtcatcgtctgctcctgccgccggggccaaagtcctgcagatcgcgctggagcgctgagtcgattgccttccgcatcatggtgttcgcgaagtcgccggacacgccggtgtagagagcggtcgtggacgcatactcgtggccgacctgctgctggatgaagaccgggtcggccccgtcctcgatgctgtgcgtgacgtacgagtgccgcaagcagtgcggcaccaggtcctcgtcgagcttgagggccttgcgatagacggagaatcgctcgtcgatctccttcgcggacaggcgggtgccccgttcactcagccacaaggctttgctccggtcgtgccccttgaaccgcggccggatgttggtggtgtagtcctcaaccgcctcgacagcccacggcatcgtgctgcagacgctccgccgtttcggtggctggccccgggacgacttgccatagcgaacctcaagcatgccgaaccgtccgaactccttggccttgggattgcgataccagtcgaaggtgtccagccgggcagtctccgtccgccgcaggccccagccatagatcaccttgaacagggtcgcgtcgcggtaggcggtcagggctcccttgcggccgcgtcggatcgccaagtcgacgcgttcgtcgatgtggtcgaacaactgctgcagttccccccgcgtcatcggccggcggtcgggatcaccctcgtagtccagcaggtgatcgagggtgttccactcgtggcagacctggatgggatgggtgccgaaccgcctctcgcactccacggcccagtcgtagcgaggatcgaggaggtagtcgcagaacatcctgacggccccctgcgtcgccctgatcgtcgacggctgcaagtgcttctctgcgaccagatgcgtcgtccattcatccatgtccgcggcaccccacgtccatgggaaggcgtcggcgaacttcacgaacctgcggatggtagcgatccggtcgctcaccgtcttctcctgcaggtgccggccgcctcgctgctggcggccccaccccgtgagcatcgcctcaagcaccgcatccgccgggtgcaggagacgtacgccctcgaccaactcaagtcgcgcggacccgatgggtgcttctacgtccctggccacaaacccctcccgcagaacgcaagtatcttgcagtaaacgggagggtgacgctagtcctgcaggtcagcgggctccatcctgcgagctcgaagcgaaggcgagcgtcagcagatgcactggcagacgacgtagcggacatctggatcactcacctgatgcaacttccggcgcttggcggaggaactcttcgccaccgcccccgcccgcgtgatcgacaagcaggaccagaacttcgagcagcactgggacgccctcgtctcgggctccactgcccagctgcccctcctctgaaccgcccctcaccgccacctccggaaggacttcccgtgggcgcacccatgccctcaggccccgcacctcccccgcgtctccgccatgctgtacctggccacgccgtccggagctgacgtacgggccgccatgcaggccggactcctggcctgcatgacgaccccggcccagggcaacgtgatcccgcccggcgccctgtacgcgtgcgacaacggcaagttcggcaagggatggcccggcgagcaggcctggttcgcgtggctgacggcgaccgtcaaccgctacagccgaggccgctgtctgtgggccgtcgcccccgacgtccccatggacgccgcggccaccctcgccgagtcgctgccctggctggagcccatccgcgccctcggtatcccggccgcattcgccgcccaggacggcagcgagcacggcctcatcccctgggactcgatcgacgtgctgttcctcgccggcagcaccgagtggaagacctcaccggccgcccaccggctggccgttgaagcccggaagcgcggcctggccgtccacatgggccgcgtcaactcccgtcggcggctgcgcatcgcgcaggccttcggctgcaccagctgcgacggcacctacctcgcctttgggcccgacaccaacctccccgcctcctggcctggatgaacgaactccacgccacgcccaccctgtttggagacgaagcatgacgacccgactgcgccatatcggcgccgcgatcatgggcatcctcgaccccattccctccaccgtgccctccccgatgagggaggaggaaggcgcctgggtacgcgcgcacgcctggaccaagggcctgcgcaagatcgaggacgcctacccctgcggcttccaccgctggtgctcctgcgagcgcggcatctgccccggttgtgcctccgggcaccacgaccggtgcgtcagcgccggcggcccccgcgtcgacgagcacgccgacaccatcaccgacgcccaagggttcgtcgtcgccgtgatccggttcagacctggccaacggccctgccggtggatctgcccctgccctcacccgacggccgtcgaagagaccgccgagacgggcaaacccgagaaaccccctgccgcccagcacgccgtccctgcgcagcggcctgcggtcgccccggagggacagctccccctcttcgcgagcggcccgcaggagcacggggacggggaggcaccgtgaggttcccggtccaggagaccctgccgttcgaggacctgccggaggtaccgaccgcgtccccctggtgccagcggtggcgcgaggggaggcattcctgggcgcatgtccgcgacggaggcttcgacgcccgccgatacaccgtggacgtcatccccgacgaggagcccgccaaggggttcgtgctcgcacaccattactccggctcgtacccggcggtgacggtgcaattcggcctgtacgacgtcgtcgacggcgagaggcggctctgcggggtggccgtgttcggagtgccggtcagcaccgccgtcctcaccaagccactgcccgagctccggccgtacaccgagtcgttggtgtgctcgagattcgtcctgctggatgagtgcccggcgaattcggagtcgtggttcctcgcgaactgcctaaaacgcctgctcgccaggggtgtacacggagtcgtctcgttcgcggaccctgtcccgcgccggaccgcttcgggacttctggtcatgcctgggcacgtcggcacgatctacgcagccacgaacgcggtctacgccagccgggccaccgcccggacggtgagccagcagcggctggacgagctgtgcgcggaggttgagcagattgctgagctgctggtcgcccgcccagaggcggcgggcgaggcgatcgaggcgttcaacgcgatgaccggtcacgactacgtggctctcgacttcgctgagtactacggcagcaggagcctggaggagttcgcgaaggaggcggcccggccggctcgccccgtggttgcggacatcaaccgggacgagctcgttgagatcgttcgcagactcctgactgcctctgcggagagcggctactatctgcggctcctggaggcgaacgtgtcgcatccccgggtgagtgacctggtcttccatccctcggacatccttcaggacccgtctgcggagcagattgtcgacgaggctctgaagtaccggccgatcgcgctctgagcgaatcgaacgacaccgtcaccctccgcgatcgctccccaagatctgtgccagaaccccatcggggtcggtcaaccgcaaggtaatccggtcactcagcgtggctgcaccacagaacctgaggcagaaccacaacccgtgaataaagccaggcgtagtgaactccatgatcttagaagccgtccctgtcacattgcggggcaccgctgcactgacagatcatcacgaactgggcgtcacgcaaacatcgccggagccctgggtgcaactccctcccccagcgaagatcagagtcgcctagagtgttgctgcctcatgaacacgtcacacgacggcagttcacacagcatcaggaaggtgcccatgaaaattcgccgaatacttacctggttggccgctacggcagcaaccactgccctgattctcttcggggcttcgccagcaagcgccaccgtgtactggcagacctacagcacgaactcgaactggcactgcggacccaccaccaagacccctctctcgaactatgtcgtgttccagacgtgcatcgtcgtcacgcccgacaagaccaaggggcaagctgtactgattgtcacgaacagcagtaccaaggacgtcatcctccgacaaggtgaagtccactctgacgagctgtatggcgtgaacgggtattccacgtgcacctacgactacaccctcagcagcgggcagtcccgcgcctgcttcggcccgacggtggcgttcagtacatgcggagatggctacgcatggggggtcctgcacgccaacagttttgactacgccatgggaacggaaacagtcagattcgttaccacgtgctgacgcccccctgctgaggcttcttcttccgcctgcgtagtccatctcgcgcgttgcagtccggcgagtcgttcggcgaggaacggggcgctcggtgtcgttcccagtcacctccagcgccgctcccgggtgcgggggtggtgaggggcaggagggcgagggcggcggcgataaggccgcgctgcacggttttgatcatgcactggtgataacggccatggtgggggcactgtccgggctttgagctgtgcgccgcccgtgtggggggattggtcgtaccggagaaacgacacgcctcacacagccggggacctggcggtgccgcagcgaactgcgcccctgcacctacggtgtctcagcgggcctcactcggacgtacggacacaaaatgcgatacctcgaaggcgcgcgcaccgtggagggcaggcggcccggcccgcatgccgccgccccggcccgaacgacgtgtccgcagcccccggccacgtacaccgggcatcgcaccggtcgctgcgcggacggtgaggacccggaaccgtgacggcaccgggtcctcacccacttcgcccgactcatgcgggactgcgcctcatcagcctgccgagagcaacgcccgggcatggcgagattggagcgggcaggatcaggggagagcgccccaccggttgggcgtactgcagggggagggtacgtgccgaagccagcgaagaagcgcggggtgcggatcccgtgggtcaccgacgcatgcggggatcgctacgaccgatccgagatcagtggccggcctgatcgcgatggacgccgcccgccaggcaggcgtcgccgaccgcgtctggaccgcccacgcgagtctgggaccgatggagtggcccgccgtcaccgtggacggagtgcgctggccgagtgccagcgaactcgctgcacagcacagccaggccctcggcgtgccgcccgagcggcatgtcgagatccgccgcagccgtgaagtcgacggtgaacgggtgccgttcgacctactggccttcatcgcggaacgaggcgactggccctggctcggccgggcccgcacctgcacgggcccgtggaagacgaagatggtgtaccaggcgttcaccccgcaggtccgcgcgctcaggaaggagacggacggcccgctgatgttcgccaacgtgctcgggatgcgggccgaggagagcccggaccgacgcaaccgggagatgtggcgccgtactaccgacaactcggcccggatcgtcgacgagtggctgcccgcgcaccaggtgagcaccgaggaggtctgggagcgcacgatcagcgcggggctgccctaccactggtgctacgactcgtaccccggtgccaaggaccggggtggttccagtcgctgttcgtgctcggcctgcaccctggccaatcaccgcgatctgctgctgaccgccgggcgccggccgcggatggccgagttgtgcgcgctggtcgaacgtgtccgccaggtgccgttcaacccgaacatcaccatggccgagctcatcgcgctgtcccgccggcgcgatgccccggaccccggcgtcttggtcgaggagaccgaggacttcgagcggatggaacgcgacgtccacgccgccctgcgcaagccgcccacatgggactccaaggcccgtaccgggccgggcgagatcctgcacagcgccgccgggtgcgatggctgccactgaccaccacaccggcgctcacccccatccgggagggatactcaatgacgatgacgacgacccagcgcatcctcgacctcgctgcggcggcaccggccagccacggcgaggacctggtgctgctcctggccgaggcaaacgagctgtaccagcagggcctgcaggagctgcaccgggaaatggcatcgcgtctcggcgggctggccaccgaagacctgatgttcgccgctgagactgccggtatgccctgcgatgcctcgcaggaccgcgacgaggtgatcctgctgctggccctggtcgagtgggagatgacgccggccgccatcgcgtacgcggagatggccgaggacgccgcgcgccgcggtgtctgcctggtccccgaggaaggccgtgagccgtgagcgcgaccgtcagagaagaaccttgagccgcgggctggacctccaaccgcaacttctgccattatttgcgttgtgagtcgggctggccggctcactgctgacaggacggacggttctgccatgacctcgcgccgtgagcctcgcctggccgacgctgccgagatcgcggctgaacagggcctgacaccctcacggatcagccagttctacaccgagcgcgcggagaacgcggccggcaggacattccccgatcctgtcgacaagcgcggccgcgcccgcctgtggaaccacgcggaggtcaccgagtggttcgccgaccgggcgccgtcacggctcgctgaacacgcaccgccctccctccctccggggacgttactgaacgcggcggaggcctcgaggtatctcggctacaagaactccagccaggtcacgaccttcgtgcgcgatcaccccggttacttccccgagccggatgtcgtcgaagagaagggcacggcggcgaacccctaccgccggcagttgtggaaggtagagactctgcaggcgtggatggccacccggcccggccgcggaagacgagccggagccaaggaggcgccgccgctgcccgacgtgccggtcgacggcgatcccgaggagcttctgggggcgagccaggcggccgccctgctggggtacaagaccgtcggctccttctcgagcagcctgtcccagggcaaccttccgctactgaagaccacggacggggtcgcagagaatgccgggcgccagaacgggcgccggcggtggacgcgccggcgcatcctcgagcaggcagcccaacggtccaagaagtagtacccctggcggtgcgcggagctccgctcaccgccccatgaacgcgacagccggctttgggtgttggtcccttgcgggccgggtgtcgcacgatggccggcatggcgcggctcgccaccgcgccccgcagcagcctggctgctgcggaccggccatcgccgaacttctcgtggggccgccctcttttcagttcgccagtggcccctggctcagcagatgacggccctcgctgccggagcgagctgcccttgcggatgggcgcggcccgtggtcggggccatggatgccgagcagagtgcagaccgccaggctgtttcgcctttgtgaccatggtcggggcttcttggtcggggacctggtcggggccgacgggtttcctcgaacagcaaccgcaggtttccgtcggagaccaccacggccgtggaaggaaacatctcatgaacagcgccgcacagagtattccggcgacggcaatggcccccactcccgctgagcccttgacccaccaggtgctggccgggctcgcccagcaccgcatcgccaccaccagccagatgcgtcggatgttgcgaccggacggcacgcggcagctgatgtcccgcgtgctgaacaggctacgttccgacggcttcgttgactgcacggtgctgccggacgcgaaccgaacccgtaccaacgcctggtacctcacgcaggagggcgcacggctgacccgggacctgcccgtcctacgaggacggccgccctaccccatctcctcgatgacggcagcatcgctgaagaccccgcacacgctcgccgtcgttcgcgctcaccttgctttcgccgcagacgcccgccggctcgggcacgagcacggcccctgggactggacccctgaggtgtcccactccatcggtgagggtgagcggatcgtagccgacgcggtgatgtactacacggtcgtcgagagcgaacaccggcgaaagctgcgcgcgttcgtggaagtcgatcgcagcaccatgagcagtgagcggctggccgtgaagctgatcgagtacgcccgcctgttccagtacgaggcccagcccgtcggccggcggaggcaggcgtccgtaggtcctgcgtggctgcgctggtatccggtttttccccgtgtgctcttcgtgctcacaggtgcctcccgggtcaggctggagaatcggatgagcgatctgcaggcgatggtggctcagcacccactcgtggcgggtctcgctcgggaggtccggctgggagccgccgtgcttgaagacctggagcagcacggtcccgcccaagacgtgtggatgcctctggtcggaggtaattcgcgcccgtggacggacctgtgaggtgaacggccggtggtcgctcagcggggaggccgccagcgggtgaacacgcgaatccctcgccgggggcgtacacggtatatacgcagcccttatagaaggcgcctaggtcccgctcggtctccaaggacccgtgcaacaggaagtagccgagctggtcgtagacctgccaggcccgcttcagcaggaagctggcgaggccctggccgcgggcctgctcggctaccgccaggccgtgcactttgccaatggccacgctcaggatcacagcctgcacgttgctgtacccgtactccagagcccgctcgatgatggttccgggggcggtgacggacagagcgccgatcggctggtcctgctcgttggcggccacgagagtcaggctgacactggccatcgagtcggccctcgggtgcccgatggtccggcgcgcgaagtcctcgaaaaatgtcttggtggtgccgtccagaccgtccaggagggcggcacctgcggtgccctgctcgatggaggaccgcagaccgggatgagccgggccccggccgtgtcgagcagcgcgtcgacggtgtccgcgtccgctgctgtggcgagccgcacgcgggtgccggcggggccgggccagcccttccgtagccggtcggcggacagccgtactcgtctgctgctgcccttcttcgcggtgcgcttcgccatggatagcccccggggtcggcgtgaactgggacgaagctgagcgccatgagggatgctgtccaccgcgaacgccgttcaaggaccgtttcccggccgaatgcgccgcacagcgagcacaggcgccggcgccagcgttaagtgttgatcagtctgccgccccaggacgccggtcctggggcggcagacgtttgtctgaaccatcgtggccgctgatcagcgttctgctcccacgctgctgtcaggcgctctggcacagcggcggcaggagtccgtcgcccggccagaagggttgctcggccgcgacgccggtgaggaacatgccgacctcggtcaggaccttggtgcggtcgtccggtccgtagacggtgaaatcccctgctgcagcgttgaaggcgcgcacttggttctcggggcctgtgcagatcagggcccgggcaactgcgggaagtccgaggctgagggcgtcgcacctctgtgtctgcacgagttgcaccaggtcggcggtgacacgttcccagtcgccgaccgtcggccagtcggcgcctccgttcagttcgtgggtaagggtggcaagcgggatgacctcgcgcggctgccgaccttgggtgaggaggtcgtggatccgggtgccgtcgggctgcaggatccacgggtggagcagggtgtcggcggcgaccacggtggtgttgatctccaaggttccgggtccggggtagtagggctcgtgcgcgaagagcaggtagatgtctgaggtgcgggcagcagggttggattggggcatgaggggtgttcccttcggcggtgaggtgccgggcgtgtgctgaggtgcttgccggtacgggcgaggcggccgctccggctcgcgggcctggtcggcgtcggccggcgctgaccgggcggatgggtacctgaggacctgggcgacctggtgggtgagctggagcatcagccgttcgcgtgcgatgagttcacaggaggccgagcgggtgtcctgggtctggagcaggtcggcggcatcccagagcaggtgctggctgatctgggccgaccggcgcagttcgtagcggtcgctgacggcggcggcctggacgaggtaggtgtgcagggctgcgaggcgctggaggtaacagcaggcgctggcgccttcgacgctgcggacgtgttcgcgggcccgggcgtccagcgtggtcggcaggtgttcggcgagcagcggcgcgagcacgatcgctggcagggcgacgtcggcggggatgccatcggccatggcgaacagcccggccagcaggctgaacaacgcgaccgcgacggtgacgacgcgcagcgagccgggggtgccgggggccaggctgatgcgtcggccggggcgtctggtaagccagcgcagcgccaagcgctgcgtgggtgtggccgatggggtgaggaccccgatctggtgagggagttcgggctgggagccgtcgcctgggatcgtccaggcgagccagccccaccgggtgcgctcgtagacgagtacgggttcgcactcggctgtacaggtgtggtcgcgtacgtggccggttcgcagggcgcgtgcgtgttccgcctcccaccggcccaggtcagccgggaaggggtgcaggtgctgggtgaagccgcttggcgttggtctgcggcgggtgtcggtcacgagttgcttccttccggttggtcggtcaggcggaggcgcacgtcgtgcagcggccgtcgccgtcggggtgggctcgcttgcgagttggtccggggcaggtgcggcacagtggccagccgaggcaggtggggcagaggtcgtcgccgggggcggtggcgggcacgccgcagccggcgcactcgacgagggcccggtaggtgagggcttgggtcacagagcgggcggcggccgctgtcgatgaccgctctctggtcgcctccgcgaagggttcgtccagcggggccgcgccggggcgggcggcggtagcgggcggcgggtaggcctgggcggcgcggagccgggcggcgatgatcgcgccgatggaggtgcgcaccaggttcggcagcggtcggctggtgatgacgtggcgcagctgctcggcgctccagccggcttccagcatcacggtcgccacgcggccttgatcggtcagtgccggcccggtcagcaggagttcgggacggctcgccccgatgtccagcagcagccggatacccgcgtgcatctcgtctgctggagtcggcggcttcggcgacgttgtcgcgtgcgaggggaccgtccgtgcgttcgtgcgcgcggcgtcgccgcggtcgcacggacggagggggttggtcttctgcttcgtggtgttctttctgttggtgttcttagtggggcgattaaccgacgtcgggttatccaccggtggaaaacccgacaacggttgcgagctggtgttttgcaggctgggcaggtccgtgatgaagtaggcggccgcgccgagggtgccgtcggggtggcgctcgcgttctcggaggaggaagcggtgcttctccagctctttcagcccgctcttcacggctgcctcgccgtctcggccgcggcgcgccaggtcggtgacgctcatccgccagccgtcccggtgcgtgctgatgtagccgaagactcccttggccttgaaagagagccgggcgtcgcggaacaggccgttggcgatctgagtgaactggtccgccgccatcaccccacggcggacccctgccccgaagcccgcccccgcctgcggcgctgagacgaacgccgtgccagccgtctgcgcgagcgcggcgtcggcgatggctgggtggtccgtgatcgagtagacgatgtcgccgagggtcccgtcgtcgtgcctgagctgttcgcggatgaggtagccgtgcctctgcagttcgctcagaccggcgcgcacggcgtcccgcccgtcaggtccgacgcgcacgaggtcggcgactgtgacgtgccagccggtgacgtgggtgctgatgtagccgcagattcccttcgctttgaaggagagcctgctgtcgcggaagaggccgttggcgatctgggtgaactggtctgccgccatcaccccacggcggatccccgccccgaaacgggtcatcgtgctccctcgcgcgccatgagcgcgcggccgctgatgccctggagcgagggtgcgggcgcgaggtggccggggccgctgagtgaggagaggtgcgcgagatccatgccgtcagctcacccggcgcccccgaccaggctgacggccaccggccccgaccaccggtcacgatgcggcaacatgcgtactgggctgccgtggtcgggctcatggtcgggccgaccatgagcgtcctgggtgctcgggaaggatgcgcagtcgcggttgcgcagcgacggtggcatccattgcgcatgcagttgcgcaagggagttggggggcctgcgcagtcggcatgtgcgggcggctgcgcacggttgcgccgcggttggcagggggcctcggtcttggggctgcgcactcggcccagttgtgcgcaaccgggctgccgcggccctccttccggtgacggcgcgatcccgaaccgtcagcggactctcctttccgtaccgcccggggcgcttgggcaagttccccgtccccggcgccttcgtgatggtggtccgctcggtcatgcctggtacccatggtcggggctgtggttgggccgaccatgagcccgaccacgggttttgtgtccccatcgtgaccgtggtcgggggttcatggtcggtggtcgggtcggggcttgcgggttttctcaaggtcagcaagtacacgttctgacctgggagtttgaccatgtcccctggcaagcaggccgcggagagcggcgctgcccctgcgatggccgcaggcgtagagctggagaagatgaggcgccgcgtgcgtgtgtcgcgcctggccctgttcaccgcgatcgcggccggccccgtcgccctgggcgtcgcggtgatgtccggcccgaccacggttgttgccgcccccttggacaagccgactgctgtgcgtagcgccgtcgcttccgacccggcgggctatgcgcagttgttcgtcgacgcgtggttgcgcagcagtgccgacgacgcgaacagtgcgcaggcgcggcttgcgcagtccctcgcgccggacgtcgatctgccggatccggtcgccggtgcgcagccgaagccggcagcggtgaccgctgtgcgcagtgcgcagcgcgaggacggcgagtgggcggtgacggtggctgcgcagtacgcggacggccgtgtgcgctacttcgtcgtgcccgtggcggccgacgcgagcggcagctcgttcgccgtgaccggcgcccccggtgtggtggccggcccggcgcgtgccgcggtgtcccagtcgctgttcggcgtgagtgttccgtccggcggcgatctggcgtctgcggtcggggagttcttcggcgcgtacctgaccggggccggggaggtggaccgctacctcgcgcccggggtgaagctgtcgccggtctcccccgccccgtacaccgcggtcaccgtccaggaggtgtggggcgctgaggaggccgtggccgccgaggaggtgccggccgacggtaccaaggtccgtgtccgcgtccaggtcgaggccagggatgacgccgggcgctggccgctggcgtacgacatcgatctcaagtcccgctctggccggtgggaagtcgcggcgctggagtccgggactggcgggggcgggggtgcccggtgagcacggtgcagagcctgatgctcgccggccgtctggacgagacaggcgacggctggatcaacatgctcgagagctgggcgaccaaggggttcaaggcgggcctgatggctctcgtggtgatcggcatggtccagaagttcagcctcaaggccggcctcggtgccctgctgctgatggtcatcgcgctggggctgtacgacagccgtaacgacctggcggacatgttcaccgacgaggtgaagaacccgtccaagggcgctcccgccgtgcccggcatcgtgcgcggtcccgatccgctcgcccgggtgcactccgacggcacgggagacgggctgtgagcgccgcgaccatggggcgggtgggccgcttctacacctccgcccgccgccacccgtgggtgctggggaaggtcgccgactggaagatcccgctcggcccatataccccggcacagatcgcggtcgccgtcggcggcggcttcctgctggtcaagacgatcagctggtggtcgtggatgggcccggtgcccatcgtggcctgggtcctgacggtctgggcggtgcgccgcccgaagatcaaggggcgcgccccgttgcaggcggcgctgggctgggtgctgctcgcctggcagccgcagggtggccggatgggcggccgggccgcccgggaccgcctttctcgtcctctgtttggcggtttcaccctcgaggtggctgctcccgctgtcccggtcatggccacgctccgcgtcgaccagcctgcagccgatcgcaaggcgcgccggggcccggcggtccgtccgtccgcgcggccgcgctcggcgccgcaggcgcgcccggtgtcggtggggccggtgtcgggcgttcagcagttgctcgccctcgccgaacaggccgggggtgcgcggtgagggtgccgatccgtcacatcgccgggcatctggtgtggtcgacgcacggcagcgtgtgggccctctaccggctgcaccccggcccggacgagcggggccgccgggaggagaccgtccaggggacgtacgttccggctgcggtccgggacgaacagctcgccaagatcacccacttgatccgctcgctgtccggggcgccgcgcctgttcgggctgtgcgctcaggtcgacccgggcgagattgccctgcgcatgatcgagggcatcgagcccggcgagacggcggccgacggcggtccgcatccgtgggtggaaaacgtcgaagccaccctggacctgctgggcgagcaggagatgcaccgccgcaccctctggctggcggtgccgctgcagaacgaggccgccggcgggcagatgaccgcgtcgctcggcgcgatgtgggcggacgtcgcgccgatgctgggcatgcgggctgcacccgtggcgcgccgcgaggtgagcggctaccgcgagcaggcttcccgggtggaggccgcgctcgccggcggcgtcgccttccgcccggcccgcccggcggagatcgtgtggatgatccagcacactctccaccgcggcctggaggagccgctgctcaccgaggccgagaccagcgacctgtacggcggacagctgcgggcggggatgctgcagtcccccagctacgccgatctcggccaggtccgcctgcaggagggaggcgtcgacctggcgctcgacgacgtcgagggcctgtccggcggggaccggatcggccgctcgggccgtaaagcctggtggcggctgaagacgtcgtcgccgctgcggcggcgctggctgcaggtggagtccgacgccggggtgggctatcaggcgcagttggcgctggccgagtgcccgcccgcggtcagccaggacgccgccgacctgttcgcccagctggagacgctcgatttccctgtcgactacaccgtcgacctcactctggtcccggcggagaaggcccgcgaccaggtccggcgcaagaagaacgaactggtcgaccaggccgaccagtacgacgcccgccccaccggcatgcccgcctccctgaccgatgccgcccgcgacctgggcgagctggacgcccgcctgtcgcgtacgtcggtcgaggtcgaggtccagtccgtcaccgtgctgaccgtgtgggggccgaccgccgccgtgtgcgacgcccgcgcccgggccctggccgcgctgctcggcggcgccgactaccgggccgtgcgccccgccgggctgcaagaggccctgttcaccctcggtctgcccggcaccgcgcggcccggtgtggtgcgggagttcacccagcaccaggtcagcgaagactgggcgctgggcggggccttcaccgctgcggaggtcggcgaccccaacggcatgttcctcggcatcgacctggactgcggcaccacccgccccgtgatgatcaacgtggcggacgcacccaagcaggacgcctccgcctccatgggaatcgtcggcgatctcggcgcgggcaagagcgtcctggagaagctgatctccgagtcggtgtgggcgcgcggcggggtcgcgatctgcatcgaccgcacccccgtacgcgagtgggccaccttcgcccgcaccgcagctgcgggccgctgccagatcatcgacgccgcccaggcggaggtgtccatcgacccgctgcgcatgttcgacggccccgaaggccgccactacgccctgtcctacctcacgctgcagctcggcatcggcccgatgagcaccaacggggaggtcctgcaccacgccgtcgagcgggccgccgccggcgacgccccctccatgcaccgtgtccttcaggtcctcgacgagatggccggggcacaggcgggcaagcggcaggacgcggccgccaccctcgccggcctcatccgcgtagtcgccagcaaccctcttgccgcgatggtgttcgaccccgcgctgccgcccgtgcggctggacgcctccggtgcctccgacatgatcgtgatcacgacgaccggtctgaagctgccgccgaaggccgcgttcgacaagcccgaggtcctgcaccagcagccgctggaagccctgatcggccgcgcggtgctctacctgatcgccgcgatcgcccgccagaccgctttcgaggacccggagcggttcaccgccgtggtgctggacgagctgtactggctgacctcttcggccgagggcaccgccctggtccacgagatcctccacgacggccgcaagcacggcgccgggctcctcgccggctcccacgatgccgaggaactcggtcccgaccgcgggctgatggcctaccgcgcgctcgcccgcaccgcagaccgtgaacgcgcccgcagaggactggagttcctcggtctcgacccgcacgaccccgagctgctgcggctggtgaccaccggcctgtccccggtcggacaacgcggccgcgaaggcgagttcctcatcgcgtgcccgcggcaaaacaccggccgtatcaaggtcgtcatcccccgcatcgagcggatctcctcctccatcaccaccacacctggacgccgcaccactgcgcccgggtccgcgccgctcgccggcgcagccacaggcgaccgtccgaaggaactccgatgacctctttcgcacccagccgttcccggcgcctcgccgcagccgcgagcgctctcacggtgatcgccgtggccgtcggcgtgctcgtcctggcgctgggggtgagcctgccggaggcctggtggccgcgcaccggacaggccttcgccgccgacgccgccaaggcgcccgcagacccgtgcgatcggatagccggtccggccaaggcgtactgcgagcgcggccgccatgccacgagcgcccaggccggcggtgacgcagccgcatggaagctgctgtcggccgcgacggcgataggcgcgctcgtgatctggcgacgccgcgcgcatacgaggcaagggcgggcttgagatgttccgtccagaccgcggcacgctgcgctcggtcggcttcgtcctgctggtcaccggcgtgttcgtcatggtgaacagccaggtcgtgtacgcggcgagcagcaacagtgagaccggtgacctgctcaccccgttgaacatcacttcctccgagggggtgccgatcaacgggtacgagctgaacgccgaaggcggctccattgtcgccttcaagacgcaggccctcgcgttcgctctgtctgggctgttcaccctgatccggatgctggtcggcctggcggggtgggcgatcgaggtggccttccggttcccgctgctgaagatcttgagccgtccggcgcagaaggccgccgacacctacgacaacgtggtcgtggacacgctcgggctgaagggtctgctgctggcctgggcgttcgtgttcgccgggttcatgatcgtgcgtggccgtgtcggccgcggtctgggcgagatctttctgactcttctcatcgcggcgttcgccgcctcggcgttcgtccgccctgacaccctgctcgcccaggacggaccgctggggcaatcccagcaggtggccgccgaggtcgcgcagcagagcgtcaactcctacgactggggaggcaagctcgccagcaaggggccgtgtgagggcatggcgggcagcgcggagatcacatgcctggagcgtgaaggcgaaggcccggtctccgcggcagaggtggcccgcccgatccaggactcgatcaccaacgcgctgatcgtcaagccgtacatgctgctgcagtacgggcgcatcctcgaccccgccaagcctgccgaccgcagggcctacgccgtccatctgatgtgggtcaccggcggatacaaggcgggcgccaagaaagacaacgaggacaagaaagacgcctgcgccaagatcaagggcgaggcgaagaagtactgcgagcgcgacaccgacgttgttcccgggaacaacggaagcggcaccctgccggagctcaccccaggcggtgaactgctggacgcctcccacgcgatcgtcaccgacgaggaccgcgagttctacgccttcctgcaggacatgaagaagaccggtgacgtcggcaagtcctgcgccgcctacgccgagaagcccacctggtggcgggtcggcggggccgccctgctgctcatcgccacgttgttcatctgcggcatgctgctctccagcgccattgtgctgctgggcacccagggcatctgtgcggcagccgcggccgcgggcggtgtcactttcatcgccggcatgctgcccgggcccgcacgccagtcagtgtggaagtggctgtcgatctggggcatctcggccctgaccgtggtcggggtctgcgccttcgtaccgttcttcggcatcgccgtggacgccaccatcaccaacggccccgacctgatggtcgagcgaatcctgctgatcgatgtcctcgccatcgcgggcacggccggacaccgcaggctcctgaccggaatcacctccttcgggcggcgcatggccatgcggatgcgctacgccaaggtcggcggcacccacatgcccggcgacacctccgagctcggcgccgcgctcgccatgaactcgcccgcagcactgggcggatacggcgggggcttgcgcgccttcaccggcggcggtggcggccggttcgggctgctcggcacccggcagcggctgatgggcgcgctcacctctttgttcgacggggcgggcatgccggtggacaccggccgtgtcctcgccgacgcaggcgccgaagccggtcgcgggctcgcaccgctcaccgcggcggccgccgtgagcggggcgggggcgcgacttggcgcgaagggcacccactggctgctgatcggccggcggccggacaaggagcagttggccaagtggcgcaagcccacggctgacggcgacccggacgcgggcggcccggacggcggcccggacggcggttcaggcggcggagggccgcgccgtcctggcggtccgcccgatcgttaccgcgacgaggacggccaggtcgtcgaccgccgcacggggcaggtgctgcacgaccagaacaccgaccgcacgctgctgtcgacgcgcgcccacaaccgtctggtgcgcttgcgcgggtaccgcatcctcaaccggggcggccgcgccgcatacgggacgacagtcgggctcccggccaatgtccgccgggcccgctcgggcaaatcgcagtacttgctggacgcccggcagcaggtgcaggtctggggcaacaccgtccgcgaggacggccgggcctgggccgacacaggacgtcatgtctctcgtgtcctgcgggagcacaccgacgacagcggcggccccggccccttcgtcacccgtcgcctgccggcccgtccggcaccggctccgcggccgaccgggtcctccagttctccagcccgtacgcgacaggcctccccacgggccagcgcgtccgcgtctccggcctcggtcagcacacggccgagcgcgccgccgacctccccgccccggctcggaagcggtgcgccccgggctgcagcaggcggcagaccagggcggaccgctccccccggcgacggtggcgcggagggttctgcaagcaccggcaaccgggcccggatgcaggagctgatgcggcaggccgaagcgctgcgcgagatgcgggcacggtggcaggtcgaggacggtgaggacgggtgaggacggcccggcgccgcaagacgcagtgggggtgtgtggtggtgctgttgctgttcgccgccgtgtgctgtgccgcaccggcagggaacgcgatcagcgcgtacgtggcgctgaagacgggtgcgagcgccgacggcggggtcgccgaaggcggcaccgctgcggacatcccgccgcgcatgctcaccgcctacaagaaggccgtccagcaggtcgggaagcatgtgcccaagtgccagggcatgcgctggccgatcctggccgggatcgccaaggtcgagtccaaccacgccgtgggccggaacatcgccgacaacggcgacatccgcccgcgcatctacggggtgctcctcaacggctccggggccggcgggaacaccaccgccttcccggacaccgacggcggcaagtgggacggaaccgccagtggggagcgcgcggtcggacccttccaattcttgccgtcgacctgggagggcatcggcgaggacgcgaacggggacaagacggccgacccgcacaacgccgacgacgccgcgctcggcgccgcggcctatctctgcggcaacggacgggacttgaccaagcgggcgcagctcaaggcggcgatcctccagtacaaccactccaatgagtacgtctcgaacgtgctgggctggatcgaccagtacacggcggccgcgaaggacccggacctgaagaacgtcacgggcaaggtccgcaccgtcatcgaggcggcgctctcccagcggggcgtgccctactcgtggggcggcggcaacgcgagcggcaggtcgtacggcatctgctgctcccccagcggaaagagcggcgcaagcatcaagggtttcgactgctcggggctgaccctgtacgcctacgcgaaggctggcattcagctgccgcgtacggcggctgcgcaggccggggtcggccagcgcatccccacgagtctcgggtccgatgcgctcaacgccggcgatctcgtcttctatgccgacgctcccggtcatgactcgacgatctatcacgtcgggatttacgtgggcagcgggcagatggtcaacgccgcccgtccggggaccgttgtccgcctggacgcggtcaacgcgatgtcgggatacgcgggaggggcccgcctgctgtgaccacgtccccggcgcgctcgccgcgcctgctgctgatcgccactggggtcctggtcgtggccggggtgatcctgctgacggtgccgcatacgcagagcgcaccctcagcttcggcgccaccgcgtgcggccgctcccacgtcgcatccctcggcgtccgcttctggcggccgtactgggcaggccagcgggctcgcgccggccccggcctccaccgcgtcggcacagtcggccagcgcgtccgcgctgccgccgcacggcgagggcaccgccggcgatgccgtcatccacaagtcgttggaggacgcctggcccgccgatctcgccgccgacgaggagcgcaagctcctcgcggccggccgtggcctgctgcgggcggacgccaccgggatcggccgcgccaagtggcccgcgatcttcggcgacccggaccaggcggtcgcaccggcgttcgccaccgcccgtttccgtatccaggccgccatcgcccgccgtgacggcagccctaacaaggcggtggtgcacctggtgtgggcgggcaccgaccgcggcggcacctacaccgaccggcgcatcaccgaccggtacttcacccgcacttcgacgaaaggagcatccacgtggactccgcagccccgtacctgaccggccaggcggcgccgtcagcgtccggctcggtattcggcatgttcaccggcatcattcacaccgtcggctgggtgatcgcctactggtacgttcccgtggctgccgccatcgtcatctgggccgtgagcgagacggcggtacgccgcctggcgaggaaggcctcggccgagcggatggcgctggagctcgtgccgtcgcggcacttcgaccccggcctggaggagatcttccgccgcggagtccagctcgcccgggcctcgacgagcatgccgtggtgggcgccgcgccgtacgaaggcggtgcagatccggctgcgcgccgacgggtccagtccgctgcgctaccggatcgagggtcccgccggcggcgaacgtctgctgtcgatcactcccttcggcccgggcgtcacggtgaaccgggctcgtcccctcgtcgacaagccgcgtgagcatgtggtgcgggcggagttcatcctgcgcggcaagcccacggccccgctgcgtgaagtgccgctggacccggacccgttgcagccactgatcgatgccgtctgcgacctgcgggcggaactgggtgacctggctgagatacggctcgacatccagcgggcccccaagtgggcgcttcgggcgcgccgtgtgcagctgatgtcggacgctcgccgcagggagcgtcgcgaggctcagcgggctgccaggtgggtgcggcaggacgccaccggcatcgaggactcgctcgcctggcagttgcagcagttggtcagccggaagcaggacgggggcgggcgccgtctggtcatgccgccggtcccccgccgggtggacccccaggacgcgctgggcaagctcgccggtgacgaccatctcgtccgtgtgcagctgctcgtgatgtgcgcctcgaacaccgaagggcgggccgaggcgaggctcgcccagctccaggccgcgttcgacgtgttcggcgggggctcgcggtgggcgatgcgcgggtggcgcgtaggtccgtggcggttcggcgcggaccgctggcccagccggcgcggcttcgagcgccgctggcggctgggacactgccagccaccccgcccgaactgggtgcgcctggaggaattgctcggcctgctcaagccgcccacggtgcactgccgtctgccgctgctcgccgcagacctgccgaccttcgagttcgggaaccccgagttgctgctgcagggcatctaccgctcccccgacggtcgtcggcgcttgatcgccagctacgccaaggagacgctgttcgaggtaggggtgggcaaggcgggcggcggcaagaccgaacgcgccctcgctcaggcgatcggctgggcgcatgccggaggcgggctgctgttcgtcgacccgcaccgcgactcctggccccgtgctctgccgttcctggcccacgacgcgctgatgcagcggatcgcactcatcgacctcaacgcccatgggacttctccgcacgtgagttgctggaacccgctcggtatgcaccagggccagacagcgcacgaggtcgtcgaggccaccgcggacgccttcgcgtccgcgctcggctgggacgacgccagcgcaccccgcgcgctgacgatcctcaccgccgccctggcggtgctggtggccgtcaacgaaaccgcatgccaggccgggcgtccggaggaccaggccacggtcttccacctgcgggcgctactcaccgatccgctcttccgcgctgcggcgctcgccggggtggagggacggctcgaggaggagacccgctcctggtggcagacggtgttcccgacactgcccgccgactccttcgccgtggtcctcaacccgatcgcccgcctcgccgccaaccccgtcacccgcgcgttcctcgggcagccggccggcgtctacaacatccgcggcgcgatggactcgaagatgatcgtatgggtgtgcccgggcgggaacggacccaccgaccggctgatcaccgcgctgctcgcccgggacctgctacgcgccgtgcgctcccgccgcgacacccccgaaggccagcgggtgccgttccgcccatacttcgacgagctgatcaccctgactggcgcggcccccgaaacgatcgccagcatgttcgaggacttccgcaagtacaaggtccacgtccacggcatgacacagctgctggcccgcctgcccaacccggtgcggctgtccctggtccagaacgcctccaccctggcctccaccgccggctcacagtccgccatcgccccgatcaccgcggaatggggcgaccgccccggccctgacatcgtcgccgccctggaccggttcgagcactacatgtcgctgacggtcaggggcgctcgcgtcggccccgtcccgatcaccggtccgcacctcgacgaagtcttcgccgactacgcccgcccccgccaggcggcagcactggagcgctccgcccgggccatggccggggctgcgccactggaccagctcacagcactcgccactaaccaactgaaccgtgtgggcgactttctcgcccagcacgcccccaccacccggcccgccgcacggctgcagaagaagggataccagtgaccaccgccttcgagaccctgtcgtccggccgcacaccgagtccggtcgagccgctgccgcatcagctccttgcggtgctggggcagcaccggatggcaacaaccggtcagctccacgacctgttgcggcctgacgcggcgcggcagaccgtctccacaccgttgaacaagctgcgccgcaagggcctggtggactacgcggtgctgccgcagtccaaccggtcgcgggcctggtacctgacaggggagggtgcccggctggtgagggacttccccgcgctccggggccgtccgccgtatccgatcacctcggccacggctgcctcgttgaagacaccgcacaccctgaccgtggtccgcacccacctggcgttcgtcaccgatgcccgcaggcgtggggacgaacacggtcacctggactggacacccgaggtctcacacccgctcagcgacggcgagaagatcatcacggatgcggtgatgcactacaccctcatcggtgatgatcagcggacaaagctcagggcattcgtcgaggtcgaccgaacgaccatgagcagcgagcggctcgcgtcgaaattgatcgaatacgcgcggctgtggtcgtacgagccgcagcctgccagccggtcccgagcacgtcagccggccgttcccggtgccgtctggctgcgctggtatcccgtgtttccccgggtcctgttcgcgctcaccggagcctcccggtacgtactggacaaccggatctccgacctgcaggccatggtggcgcagcatccgctcgtgggcacgctggcccggcaggttccgatgggcgcggcggtcctggaagacctcgaagacaagggtcctacccgcaatgtctgggtgcctctggctggcggcaagccgcggccctggaccgagctgtgactcggcagtctcgtgtcgaccgaatgtcgcagccttgcaactgcttcggaactctcttgacgtttgcttacgcgaaccattagtttacttctgcacaccgggtcgcgcctttcaaacgaccctgcgtgtctcggacttgggagaaccagatgcctcaagctgctagtgagattcgcatccctgaaatggcttcgggtgccgaatggcccgtcgacacccaggccgtctcgttcgtcggaagcgcctgcgtagtccaaggggccgacgacttcgacctggacgacctgaacctggtgcgccatcagttcccaggccggcgcgtcacgctcgacggagacgtgatcaccgtgtggccgactcccctacaggtcgggcgaggtgagcagcatccgtacgcgctcaacgccgccgaggttggccaccggaagaaccgacagcgcgaggtctcgttcttgcgaacagggcgctgaagcggtccgcacgaagccaggaccggcccggaacatgtgcggacggaacgagccaatacacaggactagaaatcgacatccggttccgaaagtgaccggttaagtcccgagttgtacgagtgaactccaatatcaagctgggaagttgactggcatatgcgtaatcttgcggtcacgcaacgcattaccgcagctggaccaggccgcggtaccgggccgccgtataccggaggccggaggcagcggtcgcatcgcaccgcgtcgcacggggagacaacgtgacacgcacaaaacgacgctcgtcagggctcaggctcgccgctgttcgcacccggaagcacgccacagccgtacttctcgcgggcagtctggtggcgcttgccggttgtagcgatagcggcacggacgcgtcaccgccccagcccagccgtactcaaacggctagcccgtcgtcgtcccccagttccacagctgatgcggaggacgccgccgtcgtcgccgcgtacacccgctcctggagtgcgcagacggaggcctacaggaaggcatcctccgcaggcaccgatctgaagaagaacaccactctccgggccctggctgacatcgagagcgacctggctgcgatgcgggaggccaggcaggtaacgaccgggattccggtgatccacccgaaggaacccaaggtgacccacggtgagattcccaaggccaccctcacggactgcgtcgacactacgaactggacgctgatcgacaaggcctcgaagaagccggtcccgcttccatcggagcgactcatcaaatacgtcagcaccgcgacgcttgaaaagtgggggacgaagtggatggtcacggagttgaccgcgaaagatcaagcctgctgacccggcgcctgtcattactcatcggcgccctcgtcctggccgcggcaggcaccgcgcacgccgacgacgaccccgatgtcggggcgggcaagtgccaggtcatcaagttctgcgtcggcgtcggcgtggacgacgagaccggcgggaagggcacccagacgggctcgcagggcagcagcggcagcaagacgcagtgcaagctgaccaaggtcaacccgaagccgccggccaaccatccggtctggaacggcgccgaccccaagaagagcgacctgtacttccgcgcttgcacggacggcggcgacggtttcgtcgtcgtaccgcagggccaacccgcaccccaggtggacccgcaggagctggcgcagcgcgcggtcgactcgatgacgctgctcggcccggacatcgccagcccgcgcggggccgggaagtacacggtcggtgtgccgacgtggatgtgggtcaaccagagtgccacgaccttcgggcccaacaccgcgtcggcctcggcgggcgggataaccgtcaccgctaccgcgaaggtctccaagatcgtgtggcagatgggcgacggcgcctccgtgacgtgcaacggcccgggcacgccgtaccaggcgtccgagggcatggcccagtcacctaactgcggacatgtgtattccaagagctcagctggtgcccgcagcggcaagtacccggtgaccgcgacgtcgacgtggacgatcgactggcagggcggcggagctgccggccagctcaccgagatccggcaaaccaacgtgcaggtggcgatcggcgagctgcaggtcgtcagataacgccgccggaaggacagaacgttgagcaagtcccaagaacgattagcagccagccccaacggagtcccccagcagggacgagtatccggcgcggttgctcccccacgggtgtcggcccgcaggcgccggccgggtgtcatcgccctgtcgctggcgctgatcgccgctggaggggccggtgttgccgtcctgctgctccaggtcggccaccgcaccgaggtggtgaccgtggcccgcgatgtccaggtcggccaggtcctgagcgaagaggacctgggcaaggcttccatcgccctggacccggccgtcaaagcggtgcgtgccggtgacctggattcagtggtgggcaagcgggccgctgtggagctcaggcccggttccctgttggcgccgtcgcaggtgacggaggattccttggtgaaggccggcgagcagctggtgccgatcgggctcaagtcggaacaggtcccggccaccgcgctggtgccgggccagaaggtggagctggtccacgtcccggcgcagggcgtggaggacacgggcaagtcgtccggcctctctccgaggaccatcgccgggcgggtcgtgaaggcgtccggcgccgcccctggtagcggggttgtggtcgtcgatgtcgctacttctgcggatgacggtcccatcgccgctgcgtgggtgtcggctggcacgctgcgcctggtcctcgctgctccggacggtagctgatggctgtgatcgcgctggccggctgcagcggcgcaccgggagtaaccacgagtgcgctggcgctgctgctgtcgtggccgctggagcagggccggaagatgatcctggctgagtgtgacccggacggcggggccgtgctgcacggtctgctgcagggcacgctcggcgaccggtacgggctgcggaacctgtcggtcgctgctcgcaagggcgagtccggtgacgctttctggcggcagctgatcgatttgtccagtgacgacggcaagcaggagtcgccgcgcgaccggctgttgctgccgggcatcaccgaccccgcgcaggcggcgagtctggtttcggtgtggaaggcgctggcggtggccttccgcggcatcgacgccagccaaggccatgacattctgatcgacctcggtcgcaccggggccttcgggccctccgcggtcttggccgagcaggctgacgcggtggtcgtggtggtgcgcaataccctgcgctccctgcaatccgcgcaggcccgggtggccgttctggagaagcgggtcggcgatgtcgggctcatcgtgatcaacgaagggccctaccccgctggcgaggtgcagcgggtgctgcaggtgccggtggtggcgacccttccgtatgcgccgaaggacgcccaggttctgtccgacggcgccgatcagccgcgccacttcaccaaatccgccctgatgaaggcctcccggacgtgtagtgccctgctggttcagcgggccgctgcgcggcgggcccgcctcgatccgcgggcagcgtttgttgggggcggggaggtgacccgtgcgcggtaagccgttgcatcccgatcccaccgtggccccgccacctggccgcccccagccggcctggcctcatcaggcgaatgggacggctgccggtgctgcctcgagtacgcacgcgctcggcaccgccacgcctcaggtcaccgtcgactaccaggtggcccggcatatcgccggccaggtcgccaagcagcgcgaggagttgctgaaggcgaagcctgatatggaccgggccagcgagcagcagcgttgcctggactggatcaacgaggcggtcgcgctgtggtcggactcggcggcgatggcgccgcaggaggatgaggcactgcggcgtgccgtctatgacctgctctttcgggccgggcggctgcagccgtatctggatgatgagcgggtcgaggacatcatcatccagggcccggacgaggtgtggctcgactacggcgacggtgagcgccggatggtcgggccgatcgcggagtcggaggacgaactgctggagttattaagggagttggcccggagttccgggcacaacgagcgcaccatctccacggcgaacccgaccctggccctgtccctgcaggacggctcccgtctgcaggcgatcaccgggctgggcccgatgacctatgcggtcatccgccggcaccgggtctcccacgccggtctcgacgacctggtgcggctgggcacgatcgacccgatcctgcgcgacttcctcggcgcgtgcgtgcgcgcggagaagaacatcatgatcgcggggaagcagaaggccgggaagaccaccttgctgcgggcgatgctcaaggagttcggcccggagtgccggtttgcgaccattcagaccgaggacgagctgttcgcccacgccaacggctaccaccggcaggtcgtctccctggtgggccgcgagtccaacggggagaaggacgtcaccgggcggggtgctggcgaggtcacgctgttggatctgatgcatcccgcgttgcggatgtcgctggagcggatcgtggtgggcgaggtccgcgggccggaagtcgtggcgatgatgcaggcgttgacgaacgggtcgggcggcaacctgtgcacgattcacgcccggcgcccggacatcatcttcgaccggatcgccgagctgtacgcgctcgctcaggacaacctgtccgagcagctcgcctaccggcagaccgccaacggcctggacttcatcgtgtacgtcgacatgaccgatgagacgcagatcggcggccgccgccaccgctacgtctcccacgtcctggagctgactgggatcggcgagaacggccgtcccgccaccaacacggtcttctcccccggagccgagttcggcgagctgcgcgcggtgccgaggatggatccgggctgcgtcgacgacctgcgccgcgtcggcttcgactccgcccagctgcaacagccctacggggcctggcaggcgccgctgcagctgaaggtgggggtgatccgatgaccctgttgtgggggttgttgagcggcatggccgtcatcggcgggctgatcggcgtggtggcaggcctcgtgggcacgacggcgccgcgccgggctccgttgcagcagcggtggcaggccctgcgcgccgggaaggaccagggcgaggacgtccggctgcgccgtcggaccctcgcggccttggcggtcgtggtcttcgtggccgtgtggctggtctcggggaattttgtgggcggcgcgctgctcggcgtggccgtggtcggcgtgccctggctgatcagcccggcgcagatggcgcaggaacgcatcggccagctggaggccctcagcgagtggacgcagcgcctggccggcctgctgcggctgggcatgggcctggaacaggcgatgatcaccagccgtcagggtgcaccggacgaacttgccccgcagatcgtcaatctgtccgaccggctgcgtctgggctggcggccggatggagcgctacgcgcgttcgccgaggaactgaacgacgtcaccgcggacaaggtggtcgccgcgctcatcctgtccgtcaacgaccgcggcccgggcctggcccaggcgctggaggacctggcgggaacggtccgcgacgaggtcgccaagaagcgcgccatcgaggcggaccgggcgaagccgcggaccaccgtgcggtggatgaccgtcatcaccgtgggtgtcgtggtggccgggttcttcgtgccgtcctataccaagccctactccacgctgctggggcagctcgtgctcgccttcctgaccgtcgggttcatcggggtgctcgccctgatgcggcagctgggtgccttccgccgcatcccgcgctttttgatcaccgacccgtccagcacagtccggctgcccctcgccggcgacggagccgggcgtgccggtcgctggccgtgagccggaaggagtcacgtcgtgaacctgtttcccgtcgtcctgaccggtggcgcggtaggcgccggcctcgcgctgctggtgcgggaactgctgcgccctcaggccgcgttggggccggccctgcagcgcagtgccccggccaccctgaccatgcccgagccggagctggaccgcgaggaggtgtggggccgctggctgctggcccgcctcgagcgcctgcccggtgtgcggatccccacgatcaacctggccctgctggggcaggggcggggccagttcatgctgagaaagaccacgctcgccgcgctgggtctgctctgcccggtcattgcgacgattccgtggatcatcgcgggcgtctccctgccgttctacgttcccgccggcgtgggcctcctcatcgcgggactgctgttcatcacaccggatctcgcggtccgtgaccaagcgaagcgggcccgggaggagttcgcgcacgccctgtccgcctacctggaccttgtcgcgctcaagcgggccgccgacgccggccccgccgaggcgctggagaaggccgccgaggtcggcctcggctggcccttcctgtttctgcagggcgccctgcgacgggcccggatggagaagatcccgccctatcaggcgctgaccgaactcgccgccgagtacgacctgcccgtccttgacgacgtcgccgacatcatgcgcggatcggccacggacggcgccgccgtctacaaggcgctgcgcgctcgtaccgcagcgctcaactccgaactgctggccgatcaggccgcggaggcgaacgccgccagcgagaagatgaccgcccccggcgccttgctggcggtcctggtgatgctgctgatggcgttccccgcggtcatccgcatgctcaccgtctaaggccaccccgagtcactgaacctctgaaggagcaaggagcacagcatgaagcacaccgcagcccgcacctaccgtgcggtgcactgggcgaccacgcgtctgcaggagggcctggaggaggccaagcgcaggccggaccgcggcgacatcagcaccaccaccgtcatcatctgggtggctgccgtcaccggcgctgtactgatcgccgggaccatcgccgtcgtgatctccaagtacaacggcaagctcactgggctgtgatgtctcctccggcgcggctgaaggactggtggcagggacgacgatggggcgacgaccgcggtgacacctccatccagatggcgatcattttcccgttcgtgctgatcgccacggtggccgtcatccaggtctccatgtggtactacgcacggcagatcgccctgaccgctgctcgcgagggcctcaccgcggcccgcgcctacgagtcgggtccggccgacggtgcggcccaggcacgggaggtgctggggcgcgtcgcgggtgacagcctgcgcggctacagcgtgtccgccagcagcaacgggcagcgggtgcgggtacaggtctccggcacggccatgtcgatgatcccgggcgttccgggtctgcaggtcacccagtcggcgtccggtcccgtggagcgctggacggtcccgggaaggtgaactacgtgcgatacatggcccgatgggctcgcaggcttcgcagcgatgagggcagcgccgcgatcgaggcggccatcatcctcccgtcgctgatcatgttcctgtggctggctatcgccggggggcgcctcgtcacctctggctcgaagatcgacgcggcagctgaagatgcggccagggaggcgtccattcaccgtacggcgggtgccgcccagagtgccgcgcacgcggcggccgccgagtcgctcaacgaccagggcatcacgtgcgcgtcgaccagcgtcagcgtcaacaccggcggcctcagcgtgccggtgggccaggtagggacggtcaccgtgaccgtgacctgcacggtcgatctgtcggatctcctgctgccgggcgtgcccggggcccggaccctcacgtcgacagccacctccgtagtggatcagtacaggcagcgaggtgactgatgagcttccggcagacagggctgagccgggcacggtgggatgaccggggaggcgtcaccgtgttcgtcgccgtgtgcgtcctcgccctgatcggcatcatcggcgtcgccgtcgacggcggcagcaaaatgcgtgccaccgaacgcgccgactacatcgccggcgaggccgcccgggccggcgggcaggccatcgaccccgccgaggccatcagcggcacagcgatcgtcgtggacctgcaggatgcccaggccgcggcccaggcctacttacgctcggccggcgccaccggcacggtcagcgtgtccggcgacggcaagaccctcaacgtgaacgtcaccggctcgtacgacacgaagttcctgtcggtggtcgggatcggctcgttgtcagtgaccggccagggcaaagccaccctcctgcacggcgttaccgctcccgaaggaaactgatgcgcaccacccactcccccgccacagcggccggccgcacgctgggccgggtcctcaaggccgtgctgagcctgctcgtcctggccgccgcggtcgccgggctgccgctgctgctggcctgggtcaccccggccatctgggcctccagccacgacgacctcacgcacttgctggaccggcaggatacgggggcggcgttcctgctgctgctcgtcgcggtgggctggatcgggtgggcgcagtttgcgttctgcgccgtacgcgagctgatcgcgcaggtggggggccggagctggcaggccccgcgcagacttggcgcctcgcagcgtgccgcggctctcctggtcggcagcatcctggtgctgctgcccacgagttcggccctggcctccgacgcccacgcctcaccggccaccaccgaggcccgcgtccccggccaggccccagccccgcagaccgccgagcccgaccagaccttgccggactccgcaagcacaccggcgtcccgtacttcgtacacggtccgcgcgacgcgtcccgcacagagcctgtggggcatcgccgaaagggagttgggcgacggagagcggtggcgggagatcgccgccctgaacgagggccgaaccatggtcgacggccaggtctttcgcgcgcacggctttctgcagcccggctggcagctggagatgcctgataccgccgctgccgcgggaggcatccgtacacagctgggcagggccgctcccactgctgaaggaaaaaatgagcacgttgtcacggtccactccggcgactacctgtcgaagatcgcggaagaagagctcggcgacggcggcgagtggccacgcctgttcaaggccagccggggcaagacgcagccggacggcctgcccgccatctccgacccggatgtgatctacgcggggcagcaggtcactgtgcccggcgcccagcccgacccgcacacgccgccacgggacggcgacaacggcgatgaggcgggcagccaggagaccactcccccagccacccaaaagcctgatggcaagcaaaagccgggcgatgacaggagagatgagcaggcaccagcaccgggcaccaccacagcgcccgcgccagagtcatcggcccccagcaccccagccagccgtcccgccgagcaaccggggcaggaacagggctctccttccgcgacggcgtccgcgacgccgcggcccggcaccagccccgcaccctctgccgccgccccgtcggccacggccgaggcgccgggctccgctgactcctcccccgccaccacggcgtccgagacgccgccaccggcaccggcaccggcaccggccagcagtccgctgaacctgcgcactgttctcggtgccggcacgctgctggcggccgccatcaccggcgctcttgccctgcgcaggacgctgcagcgccgccgccgcacgcctggtgagaagatcgccatcgcatcagagacctctcccgccgaggcgaagttggcggcggccgccgaaccgggcggcgctgcccgcctggacgtggccctacggaccctggcccaccaggtggcccacgaaaaggctgcggatctgcccccgatacgggccgcgcggatcggcacccgcacagtggaggtactgcccgagggcctcgcccgcaagccgcaggcgcccttcgtggctgggcaggccggctggtgggtgctgcccgccgaagcagtcctcctggacgaggagaccgcccgcgaggtaccggcgccgtatccgggactggtcacaatcggcagcaccgagtcgggtgacctcctgctgctcaacctcccccaggtggccgccctgttgctggacggcaacccggtacacatcaccgaggtgtgcacgtcgctcgccctggagctcgggatgagcccgtgggcgagcgaggccgagatcgtgaccatcgggttcggcgaggacctgccgcagctgctgcccacgtcccggatcgcacacatgcgccacgccaggcacgcactgcgggacctgagcgaacggctgctggaagcgcaccagatgcccgaaaccagtcatcagccgtacctgctgctgtgtgcgtccacgctggacgccgatctggcctggcagttcgccgacataatcgacaaggcccaacacgttcccgtcaccctcatcgcccccgcaagcgctgcggccgcgtccttccccgacgccgaaatcctcaacgcctcactcagcaagccccagcaattcgactacatcggctctgagatcacggtgcagcgtctggagcatgccgcctacctgcagatcaccaccgcgctcgccatctccgcgcaacccgccgacccagccgagggaccatgggaagaggtaccgcacgagccggacaccccgcagcgcccccgtccactggacttggccaaacccacacagtctggcgacggcgagaaacccgtgccggcgtccccgttcaccgcgggcaccggtgacagcgagatctacccggcactgctggccgcgtccaccgaccccgccagcctgaagctgctgcccgacccgaaagcgcctggcaaggcccctgccgaacccgggacggaacccgccgaaatgacgcccgacggacgggcaccgcagaaggcagcggaggcaaccggccgcccgcaggagaccccggcagccgaggccgtcggcgaagatacccaggcgcaggacctgcacgcgccggagatccgggtcctgggccccgtggaagtgaccggcgtggccaccaccggccacggcccgagccaggcacggctggccgccttgctgtacttccggccgggccgcagcgccgacgtgctgtgcgccgacatggacccggtcagcccctggtccacagccacactcaacgcccgcctgcaaggcctgcgccgcgccctgggaaacgacccggccggcaacgcgtacgtgcccaggcgccggtccggcgacgacccttacgagctgtccgaagccgtccgctgcgactgggcacggttcacccagctcgcccagcgcgccctgccccaaggcacagccggactgccggacctggaaaaggcactcggcctcatccgcggccggcccttcgggacccgcccactgccgtgggccgagccctaccagcaggaaatgagcacccgcatcatcgatgtcgcccacaccgtggccacctaccgcacacccacaggcccgcaccacgacctgaccgccgccaggcaggccatcgcaaccggtctcgacgtcgacgacagcgcagagctgctgtatcgggactggatgcgcatcgagcacgcggccgggaaccgggccggactgcacaccgcgatcacccgaatccaggacatcaaccgcaagatcgactgctccctggaaaacgagaccgagcagctcatcaacgacctcctgggccccaccggcggacgggcacgtggccgatgagcgaaccagcacgcaggccccccacgctccatatggccctccaccgagccccgtcagacgaacaccctgccttccgaacccgtggcgacagcagtgacggcgcagcggccacccgcacccgggcttgtgtcctcgggtatgccgccgcacaaccggcctgcccacaagcccgccgcatcccgccgtcgcccaccacaaccgcccgggcagagcgcccgcatcggcctgcccatcagcaccgtcgcgacttacgcaccccagcgaaagccgaacacagatgaagtcaggagcagatagcggccagcagcccgtgaagacagcttctcaaaaccagctgctgtgccttggccgggcacaacgcctcgtgatctccgccgtcgttctcggcgggctcaccatcagcggtatcggcttcgctggctcgtacacggccgtccgcgcactcgccctcaagaaaggcttcgggaacttcagctatgtcttcccgatcggcatcgacgcaggcatctgcgtcctgctcgccatggacctgctcctcacctggatccgcatcccgttcccgctgctgcgccagacggcgtggctgctgacggcagcgacgatcgcgtacaacggcgcggcagcctggccggaccccctgggcaccgccatgcacgcagtgatccccatcctcttcgtggtcgcggtggaggcagcccggcacgcgatcggccagatcgccgacatcacggccgacaagcacatggaaggcatacgcatcacccgctggctcctctcccccctccccaccttcctgctctggcgccgcatgaagctgtgggagctgcgctcctacgagcaggtcatcaagctggagcaggaacgtctcgtctaccaagcccgcctccacacccgcttcggccgcgcctggcgccgcaaggcccccgtggagtcgctgatgccgctgcgcctggcccgctacggcgtcccactaacccagactgcgcccacgggcctcgcggcagccggcatcgaaccggtgctgctgcctccggcaccacagccacagccacaggccgaaccggcagacacagtcggccgtgggacgggacaggtcaccgcagcagccctgggaaaccagcccgctgccgccaccggtggcgaatacatccaggcactcccaacggatgaaaacacaaggcccgcgacaccccccaaggccggagaccccagctacccctgcgaccccagccatgcaccgcggaagcaatacgaacgggaccgaacagcccagcagccagccggcaagccgaaccccaccgtggtacccgaccacgacgattcctcgcaaccggaagccagcgacacacctgagacgccacaccacgaagaagctttagacgaggaggagtcccgtgcccgggaacacagccgactctcccctacctacggataccggctggcctccgctcatggcccactaccaagccagtacgtcctggaccaccacgaggtgaccaaccctgaaggacatcccccgtcccttgaggaaccggacacttccctagacagtcttctgccacagcagcccagggattcgcgccgcgacgacggccgctccccagagccggcggcaaccagccctgtacgcggcacaagaagcgaaccaggacgcaccccccgtgcaaccccttctgcagagcaccgcgctcacagcccggaacctgcactcgaggagacccccgacgcggaggccggggactcatcactccctgacctcaccgcagttgaccactactacctggcctggaacgacttccagcaacagcacggcaaggaaccaaacggcaccgaactatccgcccacctcgcccaacgcggcatacacgaccgcgaaaatcaccccatcaaacccaaaacgctcacccgctacttcctcgaattccggatctacgacgcttgggccacccaccgcgcccgcacctcccgcacggacagcgaacccgtcctcaacgaccttgcctaccaaggcatcacagctcagtacaaccggcccatccaaacaaccgacctcgaaaaacgcctcccaggattcgaacgccgctggcacgcactcagctgccactgagtacgggcttgcgctcctcccacggacagaacagcaaccacaccaccctcgcaggcaagccacccctcagccgcgtgaacaacgctgcgggtcgatacatctggggtctgtcggctcagtcgagcttcgtcggtcggagcatcaccgcgaacacgggagagtccgggaacggctgctgcagaccgatggagcgatacccccaggcctcgtaccgggcctgcactgccccgttaccggccgcggggttgaccaaaagcgtcactcgctcctctgttcggccgtggagccacgcctcgtggagctgccaggcgacggagcgtcccctccacgacttgcgcaccacaatctcgttgagggagacggtgcggtggccatcctcgtgggtggtctcggcaggaaggggttccttcatcgagtcccaccatttcgtgtccggtgccagggcggtgccgaagcagaagccgactggctgcccgtcctcgtatcccagagctgcggaccagcccggacgtgcagcgtaggcagacagccgctcgttgaagcggtcgcggtcgtagaacgggccggtgagcccaaagtcccggtgtcgtacttcgacgtggagatcgagtatggtctcgcggatctcgtccagatccgcagccccgtagtgcctcacgttgacggtcacgcaattcctcctcgggaataacggtcggcccactcggtcacgaagtgtgctccggccgcctcagtggtcagatcctggtcgaaacgcgcgaacagggccttggtgcgccctgacagtgaatcagggtcgtctggcaatttcgtcagcgcggtagcgcatgctgcgtctgcgtccccttgccgaagttgtgtcgtcgccaagaggaccgtgtagtagacgcggttgcggtgatagtcaggccgcaggccggacagcgcgcggtgtaggtgggcttcggactcctcgttccggcccagccgcatcattacgaggccggccaacccctcgaattcggcccggtcgtagaagtccatgtaggccgggcggagctgctctggggtggcgcgctcgtacgcgacctctgcctggccgagggttcgcacggctgcagcacgctctccagctcccgactgcacaccagccagacgggcggcggccaaggaccggaaaagcgggtcgcggcggcacacctgagtctcccggcccatctgcgccgcggcgagggcgtcagggaactgccgctgctggaggtgaagcagggcggcgtggccccacatccgcatctccatcccggcatcgccggagagccgcgcaaggcgcaggcctcggtcgaggtgccgtcccgcgcgcgcggtctccatccggtccagggccgcccacagggcggtgcccatgaaggcggcggcgaggaagtacaggcgtcggcgaacgcgctcgctggcgtggccgatggccatgaggtctaaagcgtgctgggcatgggcgacggcccgggtctctaggccgacggtgagacccgtcgcggcgtccgcggccaccaagcgagcaaagttctcttccagccggttggcgtcgaccatcccaacgcgggaagcaccactggacagatgggcgggccgtaaagcggcggccgtgagggatgcggtcgccgtggtgaaggcgcgtcgacgcacgtcatcatcctccgatagtgcaggggtacgacgagggggaggtatgaagcccagttcctccgcgctcactccgaactctgcttcgaggacgatccgttgtctcttatgcggccagcgagttttcccggcgagccagtgtcggacgtgccgatcggacagcgcgccgagtttcccggtcaacgcctcgatccgctggttcagacggcttgctaactccccctgacttagtccagaccgctccatagctgctgcgagattgacgttcgccgtcacggccccacggtagtcctctaccccggactccggccctccgaaggtaaaaatttccggtccgaggccgacgggccctctccgctttttcctttgccctgcgcgtagtcgcccgttgactaacgaggcagagcaacggcgctgagcgtcaagtgcccggtgccgctgcacccgttcactacttccgtcgatccggaggactgggcatgacatcgactgcgctcgacgcactgacgagcgccatccctcgctccgtgcgtacaggccacgaggtgtccatcgaacgcgatcccgcttcgatgccgggacacctcacgaaggcagactccgtctggcccggtcggctccgtcgcattatccgggccggtctgaagctctggaaccagccggccctggtcgagaccgcggaactcctcacgacagagctggtcacgaacgctttccgccacggcagcggtaccgacatcggctttcgcttgctcatcagtggcgatcacgtcgtcatcgaggtccgggatggctctccggatcggcccgtcctgcgccgcgcgtcccctgaggacgaggacggccgcggtctcgcccttgtcagcgccatggccgacgaatggggcacgacctccgacggcacgacgacctggtgcaccctccctctccgcaaaggatctgaccacccgatgcaacgcaccgccacacccgtaccgtcgttacgcgagtaccccgccattcaactccccggaaaccccaacacggtcactcgagcacgcacgatcgcccgatctggactcaccgtcctcgactggcagggagacgttcacgctgccacagaggtggtagcgatccggcgaacaccccagcctgcgaccctgcttactgaggaagcgaaagggacagtgatggactggcgaacgcgggccatgcgcctggccggcgaggtcgtccgaccggagtcacgctggcacgaaccggtagccaccgtgccgcggcacgagttcgtgccgcgctggtggcagagcgacggtgacgcctggttactgcgtgacggcccggctgccccggatgcctggcttgaggcggcctacaccgatcagacgctcgtgacccgcgtcgacgcgtgccccgccgatcatgccgcccctggcgccatggccagtggaacgccgacgtcatcgtccacgctgcccagcttggtcgtgcggatgtaccggcacgcgatgatcgccgaaaattccgatgtgctggtgaccaccggtaccggctacggaaccgccctcgcctgcgcccggctcggccatgcccgggtcacgagcatcgacgtggacgccgacctggtgaaggcggcctcggaccggctcgtgctggtggcggggtaccggccacagatggctgttggcgacatcaccggtgaactgcccggcgcctacgaccggatcatcgccacggtgtcggtgcggcccgtgcccgtttcctggctgtccgctctccggccgggtgggaggctggtgacgaccatcgccggtacggggctgatcctggccgccgacaagaccaacgaaggcggcgctacaggccgtatcgaatgggaccgggccgggttcatgccgactcgccacggcgccgactacgggccgcccgcagacgacgtgtggcaggaggcggcagaggcagacggagaggacgtcatcaccagccgctacccgctgctatacccgccggatgcatgggacgtgatgtcgatgctcgagctccagatccccggcatcacgtaccggcgcagcatggacggtggcaaccgcaccgtgtggctgctgcaccccgacggctcatgggcccgcgccacagcccgcgggttcctcgactcgccgaccgtgcaccaaggcggcccgcgccggctgtggagcgacctggaccgcatccgcaaccggctcaaccgcgagggcgccctgcccgtgtacggagcccaggtcaccatcacgccggatggaacaaccaccctgacacgcggctcctggtccttcaccctctgaggctgtgggggctcggagccctctcccctaggacggctctcgccatgtctgagctactgaccacggtgctcgaccatgcatgacccgccccagggacgcgggcgccgagcacccacggcaccgtcaccaaagtctttgaccggctgtttctctgcgtgcgcgactacgctcccctcccgccaagtggcatgtcggcctcaatggaggccgagcacggccggggcttcctgctcgtcttgtgcagcgttgacgaccacggagtgtccccggcagcacacgatggtgaaatcgtctgggtcaccatccttgagcgcccccagtagccgtcaagccgccggaaacggccgcatgaccccctctgctgtccgtcactgcctctgatctgctgccgagcgcagtcttccgctttggcctccccgtgctgagcaagttggctgccgctcagcggcactcgcccccctttcgaggactctcctccatgccccttttatgtatgacgggccgggtgccctccccgcgtccctctcttttcgtggcggtgcgccgatgacccgcgatgacacgcccctgatcactcaccttgcgggccgtgacgaagaactccgcctcgctctcgaagatctcgggctggaccggtatctcgccgcaaagcgcctgcttcgggccacgggtaccgactgggggctgcgcacctcgcgcagtcaggtcctggccgtcgtcgccgccaacagccgtgcgatcgagtcgtggtgctcggaggagcccgaggacgtggacgcgaggatgatgtgggctcgcgtgctcacccagaggctactcaacgctcaccgcaggggactgtcgggtcaggacctggtcaacggtgtccacacagtctgggcggcgtgcagggctgctgcggagcggtggcccgaagacccggtgccctacgtgtgctacctggcgctggcgcagacggacatcgaccagcggtttcctcacagtccggtgcactgggccacgccggccgatgccatgctgccgccgggtccgtggagattgctgaactgggtcaaccagcgggatcccggcagccgggaggcgtatcaccggatgctccaggtctttcaggcccgcgcccggggagccctggattttgcccagtgggtagcctccgtcgcaccggagggatcggcgctgaaggttttgccgctgtacgcctacgtcgagtcctaccggctgcttcggcagcgttcgcagagcgtcggtgtgatcgcttactgggccaccgaggacaaggctcactacgcccgtcaggccctgtacggctggttcgcccacgccgatccgcgctcactgtccctgctggacctgaactacctggcgcacggactgaccgccaccggcgtgggacaggccactgccgtgttcgaggagatcggcaaccacgtcacgcccgccccgtggatccacgtcaccccgaacccccagtggtggcaggacgatttccgttccgcacgccgcagagcgctgacggctacaagcgggcgccgatgaccatccgagcacccccgcagccctgccccgctcaccgttgcccccttcacccttcacccccctttcgatcagaggatttctccgttgtctgcgagaagaaccagagtccagctcgacgatgacgccgcgctgcgcgcgcacggctaccaccccgaactggcccgccggatgggcgggttcgggaacttcgccatcagcttctccgtgatctgcatcctggccggcggcatgaccttattcggctacggcctgaacaccggcggccccgccgtcatgatgtggggctgggtcggtatcggcttcatgacgctgctgctgggcatgtgcctggccgaggtgacctccgcctaccccacctcgggcggcctgtattacatggctcaccggctcggcgggccccgctgggcctgggtgacgggctggctcaacctgctgggcctgctcggcgcaatcgccggcatcgactacggctgcgccctgttcatcggcgcgttcgccagcctccagtgggaccttgtgcccacacccgagacaacgatcctgatcttcgcgggcatcctgctcctgcacggcactttgaacgcgctcggcgtgcgcctggtcaacgtcctcaacagcatctcggtgtggtggcagatctccggcgtcctgctgatcggagggaccctgaccctcgccccggccgagcaccagagcgccggcttcgtgttcggccacttccacaacgccaccggcttcaccagccccgtctacgtggccgccctcggctgcctgctggccgcctacacgttctgcggctacgacgcctcctcccacctctccgaggagaccagccaggcacaggtgtcggcgcccaagggcatcgtccgcagcatcggctactcatggatcgccgggttcatcctgctggcaggcatgctgttcgccgtccaggactacaccggcacccagggctcgagcacaggcgtgccaccggcgcagatcttcatcgatgtcctgggcacgggtgtggccaaggggctgctgatggtagtgatcgtggcacagctgttctgcggaaacgcggaaaccgccgcggcctcccgcatggtgtttgcgttctcgcgggacggggctctgccgttctcctcgacgtggcggcgtgtcacccatcgcacccgcacccccatcgccgcggtgtggctgtccgtgggcgtcgcgctggtcctggcgctgccgagcttgtattcgccggccgcgtacgccgccgtcaccgcgatcaacgtcatcgggatcacgcctgcgtacgtgatccccgtctacctgcgcctgcgtgccggtgaccgcttccaggcgggcccgtggaaccttggtggctggagcaagcccctcggctggatctccgtcacctacgtggctgttctgaccgtcgtgttctgcctgccgcaggcctcgcccgtcaccgcacagtccttcaactacgcgggcctcgcgctggcggtggtcctgctcctcgcgtgggccatgtggatcaccaagggcaagcggcactacaagatccccccgctcggcagtgcggccgagaacacggcactcgccggtgaggtgatgtgatgtccggccagatcagccaccacctctcccccacccccgcccccgggctggtgacactcgaagagctcggccacctcgttcaaggccgtgagatcgacacggtgatggtcgccgtcccggacctgaggggccggctgatgggcaagaacctcgacgcccaccacttcctgaccaagctgcccggcggaccggagatgtgcgcctacatcctggcgacagacgtggacatgaacccgctggacgggttcgaactcgccggctggcacaccggatacggagacctgcgtgtcgtccccgacctgggcaccatccggcgcctgaactacctgccaggcacggtcctcgtacacggcaacgccgtacaccccgacggccgccccgtcgccgtcgcaccacgggagatcctccgcagccaactgcgggccctcgccgtccacggcctgcaggcacgcgtcggcatcgagagcgaattcgtcctctacaaaggcaccgaagcacagctgcgccgatccgggttcaggaacccgacacccgtgtcccccgacaacctcgactacgcgctggaccgcccgcccgccctgaacgcgttcttccacgacctgcacaacgccctgcacgaagcaggcgcaccaatcgaggccatcaaaacggaaggagccccaggccagatcgaagtggcctggccctacgggacacccccgtgggcgcatgcgacacctacaccctccacaaacacgccgtccgtcacatcgccgcacaacaccgcctcacacccacgttcatggccgccccgcagaccggcaccggatccggcctccacctgcacatctccctgtggcgcgacgacgaggcggccttcgccatgcgtccacgcgaggagctgcccgagctactccagcactccattgccgggctgatcgacgcactgccgcagctggttccgctgtacgcacccacccccaactcctacaaacgatatgtccgccactccttcgcccccaccaactacacctggggacgcgacaaccgcacctgcgccatccgcatcacaggccaccacgcctgcacacacctggaagtacgcctgccgggagccgacgccaacccctacctcgcactcgccgcgaccatcgcggccatcgtctacggcctcaacaaccatcccaagctccccgagccctgcaccggcgacgcctaccacgctgccgacccgctccccgtgccacgcaacctcgaagaagccctcaccgacttccaacaaagcagcatcgcactgcgcgcattcagcacacccgtagtgcagcactacgcccgcgctgccgaggttgagatcgaggcacagcacggccaggtcacagacatcgaccgcaagcgggggttcctccgtgcgtgatctcctccctcgtgccgcagagatccagcggctcagccctgccgctatcgaggctcccgcggccgatcccgagtgctcaggccgtatggaccgcatcacgagcgtcgtgctgtgcctgctgttcgacctggctcagcaagcggcacgcttcggctccggcataaacccgtgggggcagctcgctgtgtacgacggcgacgacttctcgcttttcaccgctgaagggtcaacatgaaatgccgcgtcgtgacctcccgcccgccggaccgcacgaagtccgcgatcacctgatgactcccgtcccggcgcggttgtcaggccaagaacggcaaggccgccaggcctcggattcctaacgatcgtcgaagtgcatggccctcgccagctgcacgtcgacctcccagtcatcagggcgagcagatggattcacccattggaatccagacttctcccatttacccctagctcgaattactcccgtgggggttgagtcttcgtacccaaactcaaccccgcaacagtcgcaaatctcgtagctgggcgccttcccgtcttccccccaaggggggtcgccctgcagaaggccacagactcggcagtgcatgtaggtgtcactgggcattgaagtagtccagattcgtcgggtacccgtgagatgcagggtctggcttgaagtacgtgcgcggcacccctgatggatccatgacgccgaactcatccgtggctggattgaagcgaatcacatccccgttcgctcgcgttcgcgtcagtacgcttggatcggtgctgcgcaggaaatcggtacccgcctccacgtattctttcgcgttattgaggttcgggaattctgacttgtgcttcttccagtgcccgaaggcgttcttgacggacgtcttcctgttggtggagctccaacagctgccgttgtgaacgaggaccggagtctcgcccgccagcacatagtacgtgtgaaggccttcgacggtgaggtcgtacatgtctgctgcaccgcgctgagcaagcacagaggtgattgtggcgtgctggttgcctgaagtgttgaccttgtggcccgtgatcagccgcccggcttgctcccaaacctgcgccgtgtcgtcccagatccggtggcgcgcagtggtgtgcagggtttggattcgtccgtcaaggcctcggatgctcagatcaacaaggtcgtcgtcgtggttgaggtgaaccgcggtgacttccctgacttctctatggtgtccggatgttgggtctgcggcctcgactaggtccccaggcttaattttgccaaggggtttggtcttcccgtccttcatcaacacgcgggtggtcggtttgaagctgcatccgcgggccttgaggaccttgctgaatgcggcacccatttcgccagcgagcaaaatgggtactgcttcggatgcttccttcatggagtcataggcgccgttgtcggcaccgcagcgctttgggttctctacgcagaaggtggctgcgactctcttcgcttttgcgaagtcgtgggtctccttccagacgcggaaggcctcggagcaggcggtgcggccgaaacacgccatgccggtccggtctccgtcgccgaccggggcatcccagtagccgccgccctgtgtcgtttggccgtagtgcacccatacctgggccaagcggtctgcgtcccagccgttttcttctcgcggaagcagatcgacaagctggtcttggaccgtgggagcgggtgtgggggtgtccccaccgcctccgacagtgcctggtccgcacttctgccatccgtcgctgcattgcgtgccgtccgaattcagcttgatcagcccggacgggtcggagtaattgatgggatcgttgccgctgtagctgtaggcagagaggttctgcgggtcgtagggcgtgctgagggggtcggggctgaggaagcgtccgaggctggggtcgtaggcgcgagcgccgaggagggacaggccggtgttggtgtcctctgttttgccgaggaagccgtggttggtgccggtcggcaggctgccactgcgttcgtcaccgaagggggtgtacctgcggcgggttgcggtgcccgtggcggcgtcgacggcgatctgggtggaggcttgcgtgtctcccatcaggtaggtgatcttgccgttgacggtgttgttgccgtcggtggtgcgcatggcgacggttgttgcgccgaagctgtagtagcgcgtcgcggtggcgctgatgccgtcggtggtgcgcagttctgtgccgccgatggaggcgacggtttcctgcggggtggtgcggacgaggaggttgccgctggcgtcgtaggtgtagcgggtgaggtcgctgccgctggtcttggtggttttgaccgtggcgagtcggccgagccggctccaggtgtagtcagttgtcgtactgccttcgacgcgctgcttcatcgccccgtcggcgtaatacgtgtatgtacccgctgccgtggtggtacctgcgctgactttgttgattttgcggacaccgtggggctggtcggcgttggcagtggtccaagtaccggcgtcgtcgtatccggggtagaggtagtcgcgggtggtcgccgcaccggccgagttggtgtcggtgaccgactggagattgccgaggcggtcgtaggtgtagccggtctggtagggggaggtgcccttgaagtcagaggtggtctttgtggtgtcggcgcagttgccggcagtggtgtgggtgtaggcgagggtgaggcgggactggtcgtcgtaacggaggcactgtgactgggcagtctgtccgctggcctgttcgcgcagttcggtgagcttgccggtgttgtcgtagaggtaggtgtccttctgtgcctcgctgaccaggtcgttgatcgtggtggttgtggcgatggacctcagccagcgggtgccgttgctgtcgtcgtagccgtactgccgctgggcctggatgccgttgccgccgaactcggccccgtagtcacgttctaccagtcggccataggcgtcgtaggtcgtgttgtcgatgtaggccgtgccgcccaggctgctggtaagacgggtgggctgcccgtagtcgtcgtaagtggtggtcaccttctccgcggcgagcttgccggccgcggggtaggaaaccgaggtgatgtggtcggctgcgtcgtaggtgaccgatgtggtgtagtcgcctgcgaggccgttgacagtggtcggcagcgtgaccgtggtgttcagtggtcggccgcgctcgtcgaacttgccggtcttggtggtgtaggtgttgccgctcgcatcgcggctgaccgcggaggtgatctgtcccttgccgccggtggctgcggggtcgtcccagacccaggcggccagttcgtcggcgccgctcctgacagatgtcgcgcggctcaggttgtcgtagccgtaggtgaggacggtctggacgtcgttggtggtggcggtggtctggctgacttggccgttctcgttgtactcgctgctggagaggccggcgtccgggtcgtcggtggtcttgcgctgtgcggcccagtcgtaggtgtacagggtgttgttgccgcggggatcggtgatctgagcgagttcgcccttggcggtgtagccgtacgcggtggtgtaagccgagctcgcggtgtgctcgacgactttggacacctgtccgtacacgtcggtgtaggtgtcggtcgctgtgctgtcgaccggtgtcacgctggtgtagtcgcccaggtaggaggtgtcgacccgccctgccttttggggtgtgcccttgacctggatctgcgaggacacggtgcggccggcccagtccaggaccaggtcgctgtaggagggcaggtcggagggctgcgggcttgaggggccgccggagccagccgttccctggttacggaagaccgcggaggcgccggtgacttgtccggccgagtcgtagcgggtgacggcgacctgtcggaacggcacgatctgtttggtcgcagggtccacgtcggatggcagaggcgtctgcgtttcccgggcccggcccagaccgtcggtgtaggcatgggagaccagataggtacttccggactgcagggtgtgtgaggctacgtgggggtagccgtcggccgagtccgggactccggcgctgttggtggaggtggggatggtgtagctgaacttcatcgacggtgagctgccggtctccgtcggcttccacacctctacggggcgtccggctgcgtcgagtgtgactttggtgatgttgccgttggcgtctttgctggtggtcggcgtggcccagaaccgggacgtccactcggtgaaggtgagggggccgcgggccgtcgcggtgccatccgggtccgggctggtggaggtgatgccattcatcggccatgtgttggctgggctgtaggtgatggtgctgcggttgtgtttgccgtcctcgctccagacgatgcggcccgccttgtcgtagccggtccagctggagcggtatctgcccgccttcgtgtacgtgcggacctcggtcgcgttgccgtcgaccggcttgttggcgtcgatgctggtggcgttgtcgtagagggtggaggtgtagccgtcctggttgctgtcggcgatgctggagcagcccacggagtagtgcttgacctggtcttgcactacggtccagcgctgggcgccggtggagtcgtaattgtcagtgttgtaggcacgcccgtaggtggtgcaacggttgtcggagacattgctctggccccagtcgtcggtgcgcatgggcaggccgaacgtggtggaagctgcctcgctgtcgtcgtactcgttctctacgacgtgctcgcgccagccgccgctgatcttggtgttggtggtggacttggattcgcgcacgaagtgggcgtcgggcaggccgtcgtactgggcggtgttgtggctccagtacgtgtggtaggtgcgctcgtgcgagatgtcagtgtcatcgcgcagcgatgtcgagagggtgtggccggccagccaggcgtggtcggcgtagttgtttccgtcaccatcattgaccgtgactgtcttcgtcgccgacgtgtccgtcttggaggtacggtctccgtccaggcctcggtagagccagtacttcttggtcttctgcccagtgtccgcgccggtggtgacctgcgtctcctggtagccgcgccagtcggaccaggactcgtcctcgtccttgaccagcggatcaccggtgaagcgccagcctgccccgccctcgtaggtgtacgaggtggtcatcactggcgcgccgtcctggttggtcgtgacggtcgggtcgacttcgaccttggtcaccaggaatttcttgaaccagccggttttcgactccgtctccccttccggggtccacttctgccagtagcagtcctgtgtgttggaggcctgggtcggcaggtggtcgatgtcgcaggcgttggcgaagccgtaggagaccttagtggtggcgccgaggtcgccgtggatctcctggatgcgggggaagttcagttctgcggagccgaccttgttgtcgaggtcggtccggttgaagttgatgaccggcaagacgatgtcgtcgccgtcgccgtaggtcttgcgctggatgtagtcgagccagagggtcttgccgatcgtgccgtcggggttgggcatgccgtatttgttctggtactgctcgaccaggtcccagcccgtgccgtcctggtcgctgacgtacgtcttgacgtcccacagcatgtccgtggagaagaacgtcgggtagtacgtcttgcccgcgcagttgtagtcggccgatgtgccgtcacacatcaggtcgaccggcacgtccggatacgaggtcggtttgtcgtcgaaggtggggcaggtggcgggttcgtcgcggaggggatcattttcctgtacgcgctcgatgcaccggttgacgtggctgagttcgaccttcgccggcagcttgccgtcggggatctgcgaggaccagccgtactggatctccttcacatagccactggagacgtactcgcgggccttgtcggagttggcgacggaacggtagtggttgtactccttgtcatagaagtacatggtctcgacctcgttggcatccaccgccctatccaggctccagcgccaggcctgagtgcacggctccgggaactggtcatggcacggttcgcccgtgtcattgccgaccaccggctcagtgaagaccgaggcggtagcggtaccggtgcgctcagagcggccccagccgaagtagtagcgctgcccgtcctgggtggagatcacccagtactcgccgtcccggcccgcgccatacccatcgaacaggcgctgcacgcgccagcccggatcattcttgaggtggtaggcgccgctaccggtgttgtcctggatcagctccgaggtgacaccgttgaggttgatgacgtagaccgcgccggacggttccttggccgagttcggagagtcccagcacatgtcgccgatggtcggcaggccgtcctcggagcagttgcggtagcggcgctcgatgtagccaacgttgaggtcccagcccatgcccgcccaggatgcctggttgttcgaggcggaggtacggccgtcgaccgactgcgagttgtacgacagtgacagcgacggcgctgagcccatcggcggcttcggcagctggatgggcacgttgtaggtgaacgcacctgaaccagtggacacctcccacgaaccggtcggcgacagcgtcgacgcccggtagtcaccggcatccgacgatgaccccgacgctagcgtgtacacactcgcgccgctcgcactggcctcgcgcatcagctgggttgaggcacccgagacttccgtgtccgcggccgcggtgaccgtggcagtcagggtccctgtcgcggtgtcgttatccaccggcacgaactcgcgatcggtgcagccctccgcctccggggtctgcaacgcacacgcgggcagtttcaccagtcgaagacgcgaggcgaagtcggcaccgtaggcgtactggaaacccgagtagtcgacatcgacttgcacctgccccggggcattcaccccgtcggtccggttcacctgcaacccaagaccgatcccgcccgccggctctacggtctgatggtccagtactcgcacctggacctgatccggcgacaccgggtcctggtcgggctcggacgtgacagaatccgggggctgtggtgaggaactagtgctggcctcggggcttggcgaggtgcttgcgtcagtgctactggaggcgctagggctcggtgagacgtcgccgtccgcacgccgttgcgccgacagctgcgtggtggcgcccacaggatccggagccggagcaacgtccacgacgtcaccgacctgagtgctgttctcgctgcccgtggtagtcggcgacggggtcaccgtgccgggatccccgggcgctgcctgcgacagatccaccgtcgcctcggcagcgttgggccacttcgggtcagggagcgccttacccacttcttccgcctgctgcgcgggaacggaccccagcgactgcgacggcacgaccggcgtcggatcatccgccgtcgcaaacgcctgctgcggtgcaaccaccgacatcgtcgacagcagacccgccagcactgcacctgcaacaccagccgaaagaaaacgcgtacgccgagcagccactcgaactcccaccccagtggcccgcatcccacacgggtcacagcccaacagataaaccgtcagcttccaggcaggccacagccgcgctccccagcacggtgacgcgcgatcccacccgcaagttgatcagtgaaccgagacagtaaccgctgtgaacgtcttgtgaacagggcaatcgaagaaaggttccatcccgcctacgtgttctcgatcatggtcaatccatgtttcaaaggcagctgaaatgcctcggggtccactgccggtcacagcggcgacgaaggccgttggcgatcgaagcagtcgccgaccgcgcccgctacaagcacaacgtgctctacccagcgccctcgcgatgcgtccccttcttccggagcctgctcgccggaacgcttcggcaggacaccgcctccgtgacaggtctcccgccgccctgtctgccgagggtccgtgagacgaactcggtcgggtgaatcaggcgcctgcagagaaccccgccgtgcacgagcgcgtactgacagacgtggacccgatccaagaaacgcatctgtccgaacccggcctgctcgtgatcgacgtagcgggcatggacgacgaaaccgtgctcgccttccagaacgcgatcgcccaaacgtgggcgacctcgactgccgaccgcaccacccaggatccgggccagcccggcgtgcggctgcgtctgtacgccgatctgcggcaggtccttgccccaacctccccgccgtagcgggcgctggcaccagcacgcaatgaggcctggtccgccaccacggggggagtgacggaccaggcctgaagtccacggtgccacacccgtccccgaacgtgcgcggtctgcgggtgaagtcgccgcaggatggcgcgtcttcgtccgagcggtcgagttacgcgcgggcccgcagcagggcgagcacggcggccgcgtacgcgcgggatcggtcccagacggcgaagtagtcggtgtgcatctgaccggcctcctccatccgggagggctggatgcgtatgccattaccgcggccgagtgcgaggttggcgcggcggctcgtctcctggctcaggccgcggatcggcgctaccggctcgccgccctcgcgcgtgccgtcggggtggaaagcctcgtacaggtcgtcgcgccctcggtatcccacgtggctggcctgcagcagacgtgcctgcttggcgacctcctgcaccagcgggtcattcgtgctgccgagccggagctccggtccgggggacgggatcgcccgccagatgcccgcgtacgtggagtcgatgctgctgatccaccactgagacgcataaccgccgggcagtacaagcggccgcggcaaccgccggggtgggcgctttccgttggcgcgccgggcaagcagtgtgtgtgccgaacgcagcagggcagcgtcgtgcgccttcatcagagccacggcgaccctgatggcgtggcccgccgccttgtgctcgggggtctgtacatacgcgcgcagccggcgctggtactcggcgcgttcaaggccggtgctgctcgggctctggcgagccgcggtcgccttcgcctctttcacacgccggccggccgcctgggcttcgccgagttgctgcgcaagccgttcgacgactccccgccactggccccccaccatgctcacgatctccctccccgctgacgcccggccgctcctcacctcaggctatcggcccgtcgtcccgcacccggcgtcaccgcgggcgggacgctcaggtcgatgacctcttggagcgggaactccagcagctctcactcctcgccttcgcgatgctcaaccggcggcgccaatgggcgtccacggctgagctcgaagaggatctggccgcgctgctcggacggcacgcgcaccggccgtcaaacttccgggaacctctggggcaggccgaaatcgccctcgggcgcttcttcggcactccccctgtccctaagtctgggccgggcgccggggggccagcttctccgtgtgccaggcgtcgacgtcggcctgctggcagtgttcgatggtgcggcctcggtcggcgagccaggagaggaaggcgccaaggtggcgttaggcgggctgaggggcgggcgtcgccggagcggccgcgaccttgcgggtctcacgcattatcagcaggccgttgaccaccatcagtgtcgcggtcaggcagtggacgccgagcgcggtggccacggagccgtggtgggccagcacggcggtcatgtcgccgtacgcggcgagggcctccaccagcagcgcccagcccagcgcccggcggtggcccgtcaccagcaggatgcccaggaccagggccaagacgacgtcgcggattcccttgatgatcaggaagccgtcgccgtcgccggacggccagctcggcaggccgaagcccggtgccgtcgtctccgggctcaggatgaactccgccccgaaccagaggatgaagaggatgaaggcggcggccaggacggtgttgatcttcttcagcgacattgttcttctccttgcgagtcttcgtcagcttggtgagcttcatgaagcttgctgagtcgtgtggagcctgatcaggccgcgcgaacgcggctgatcgaggggcgtagtttgtcgggatcgccgctgtgggatctgagcggcagctgcattcccggatgtcgggatttcggtggccagctgccgcctggggagtggggattgtgcgccaccggcgcggcgtcggcccgcggggtcaggaatccgaagccctgccgccctcaccccgacggggcgaaagccgtcgatataacggggcgaatcagcgcaggtcggggcggctttggtatcaggtgagggcggcgaccagcagggcgaaggcggcgatgatgacggcgacgcggacgtagtggaagcgttcccagcggttcatctgctgcttccagtcggcgggccggttgtcaggggtccacgtcttgttccggttgttgatcgggacgagcagcagaatcgacatgatcacgctgagcatcagcagcgcgccggcggtgacgacgaggccggtgccgtggtggcgccatcccgcgatggcccagaccgcgacgaggacgagcgagccgatgtaccagaccggcatcacggcgccgagcatccggcccccgtgggcatggccgagttggccactgtcctcggggagtgcgttgaggatcgggttcatgacgaaggcgacggagaactccacccccaccatcacgccgatgatcacggtggtgacgacctcgagtgcgttgaacatgattacccccctggcatctagtgttgctagctgatgaggcaacgctagtactgctgccgcttgattgtctagcagtgctaggatcgaatcatgtcggtacaggaacgcaagcagcgcgaacgggcggagcgcgagcgcctcatcgtggcgacggcccgcgaactcgccgagcagcagggctgggacgcggtcaccacccgccggctcgccgagcgcatcgagtacagccagcccgtcctctacagccacttccgcggcaagcgcgagatcatcggcgccgtcgccctggagggcgctgccgagatggccgtggcggtgcgggccgcggcctccagcgcggacggcccgcgcgagcgggtcgccgccctcgcccgtgcctacctcgacttcgccgcacgcaacccggcggtctacgacgccttgttccagctcgacggcggcctggcgtacgcgcaggaggacaccccggaacctctcaaggacgccttcgccgcgctgctggagagcctcggcgaggtcgccgggaacggcgtccacccggggctgttcaccgagacgttctgggcggccctgcacggcctggcgaccctgacccgggcgggacggctgccgccggaggacaccgagccgagggtggagctgctggtggaccggctcgccatgctctgacacaccatcccggcgggcacgcagccggggccctcggcctccgccactgcctgcctgcctgcctgcggcaacgcttccggtcacccgcgtccacacggcgcagcgcagatcgccgggccccgtaccccagacgggcacccgccccggaagctgcgatgctccttgatcacgacccgatactcgccctaacgccgcgtcattcgccggtgccctcatcgtcctcgtcgaggtggacggtcgccgggtcacgcagtgggcgcaggccctcgagtggcgggcgggcggcgagctgtagcggcccaggcagttgaggttggcgtgcttcagcggggagacccgggccacgtcctcgttcaggacgtcatgctcccgctcctcgggcggcagggcccgcaggtggtcgacggcggcgtcgaggtagcgcgttgtccagagcacggcggcattgaggaccaccaggccgagcgcgccgagttggtcctcctgccccgtcctgtatgcctgcatgatctgtccgcgcttgccgtggcagatgtcgcgggcgagcttgtgccgtgactcctggacggtgagctgccggttcatctggcgccggtaggtgtcgtcgaccgggtcgacgacccggagcaggtgcagggtcttggcgatgcgcccgtactcggcgaacgcctggcccagcgaggtcggccgcccctcgcggccgaacatccgcagcaggtcgtacgcgcggacctgcccggtcaccagtgagccggtgacccgcagcatctccgggcagtgtgtggtgaccttggtcaggttgaccttgttgcgggccaggtcctccagcggccggtagtcaccggtctccgcaccgggcatctccgcccgccagaaaccgctggtcgcccaggtccttgaagcgcggcgagaagttgaagcccagcatcgtgaacaggccgaacaccatgtcggagtacgaggcgttgtcggtggcggccatctccggcttcaccccggcatccaggttcagcagcgcgtccaggatgtgcagggagtcgcgcggcgtgcccggcacggccatctgcccaatacccgcgacctggtcatttactgcgttcagtcaggtgatgccgcgcttgaagtgtgaagtggtagtacttcggcgacggcccggcgtggatggtccgcttcgggacgacgaaccgcagcccgtcgactgaggccagcaggccctcaccccagaacttcacgatcggcaccttcgcctgcgcctcgatcagcttcgcgttcgccgcggcgatggtgtccacccgcaggtagtactgatcgacgtggaccagccgggcccgcgtgagcgcctcgtcctcggcgtcgatgaccggcgtggctgcgtaggtcttgagcgagagcacatgttggtgagttccggaatcactcgtcgtccagagagtgcagggatatcggtgagaagtaagagcactcgaagcggagcgggctcgcagtgatcgcatgcgcgggtagtacggaccgtggcaagatgacggcatgttgacccgaaaggccgatgccgcgtaggcgtccgagggggctgcgcgctgagcgttggcggcccataagaggtgtccccgttcgccggatccgcggtgtgtccgcggcaactcgcgtagcgatccggaagttggaagaggagcgtctgtggccgggggctgtggccgctgccctggcggagtgccggtggtatctggggcaaccagggcgcgtgctgccagatccggtgatgggctgcggctgctgtgatcctctggtagcccgcgaccgtctggaggacgtgctgctgtggcttccccgtggtgctcggactgacctcggcaggctcgttgccaggttggacgccgagttcgaccgcagggccgtctccctcagctctcacctcatgctggcaactccgttcagtgcttgcgggtattggcgccagcgattcatggagaactgagggtcgggtggttcctcgccgctcagcgctcagacgacggcctgctgctcggcgcgggcgcgggtggtggcgaggcgataggagtccgtgccggtctcgatgatgttgccgccgaaggtgagacggtcgacgatggccgcgcagaggcgggggtcggtgaaggtcttggtccagccagagaacgactcgttcgaggcgatggccacgctgttcttctcctcccgctccgtcagaacctggaagaggagctcggcgccccgccggtcgagctccatgtagccgagctcgtcgatgcacaaaagatcaacgcggccgtagcgggcgatggtcttggtcagctgcttctcgtcggcggcctcgacgagctcgttgacgagcttggtcgcgagaacgtacttgacccggtagccggccatcgcggcttcggtgccgagtgcgatcagcaggtgggacttgccggtgccggagtcaccgatgaggcagagcggcaggctcttcttgatccattcgcacttggcgagggtgtggatcaaggcagcgtcgatgttcgggttcgcgtcgaagtcgaacttgcggagcgacttgtcgcggggaaacccggcggccttgatccgccgctcggagcggcgtcgggcccggtcgtcgcactcggccaggaggagttcggagaggaagccgaggtaggacttcccaatgacgatgtcaagtcgctgccgtgacggttggtcggacctcgtagcactctccgtcgcggagcatggcccacaagacgttggctcgtcgacgggccagagcgagcagggcctgcttgtgtcccttgccctcgttccgcttgcgcccgtagtaggcctgggaggcggcgcacgttctgagactggccattgcggagaggtagaaggcccggagcaggccgcggtggtaacggcgcgggcggcgcatgttgccgctgacacgaccggaatcccgtggcacgggtgacaggccggcgaaggaggccaggcgatctgccgtgccgaaggcctcaaggtcgccaccggtggcggcgatgaattcggcgcccaggagggtgcccatgccgggcaggctgcggatcaccgtcgcgtgtcggtgatcgttgaaccgggcttcgatgagcgcgtcgagttcggcgatctcctgatcgagtgcctgcacgcccttggcgatgcgggcgaccacggcggccgcgagggtctctcccggcagtgcggtgtgctgggacctggccgcctcgacagctgtttcggcgagcgcggcggcgttcttcaccttgcggttctttagccaggttccgatgcgcctggccccgctgcggcggatcgcggtcggcgtctggtagccggtcagcagcatgaccggaccctttttgctcaggttcaacgcccgctccaacgcggggaagaactctaggagttgggcccgcagccggttggtctgacgggtgcggtcgttgaccaggtcgaggcggcgggcggtcaaggtgcgcaggtcgatggctatctcatcgccgggccgcaggagaccgaggtcctggcgcatgcgtgcctggtcggcgatgacgaacgcgtccttctcgtccgtcttgccctggccgcggtaggcggctgacgcctgatgcacggccaggccggtgatgtagaccatcggctggtcgtggctgagcaggaggctgatgagcagggcggcgccaccgtggttgatgtccaccgcccacagggtgtcctcgcagagcgcgagtacgtctgcgatcagctccagcagggccggttcgtcgttgaagacccggcgtgaaaggaggcgttcgccgcgttcgtcaaccaccacgcagtggtggtgttccttgcctatgtccactccggcccagatctggggcacgggtcacctccgccagctcgtcgtcacaatcgatcccgcagacgacctcgccgacgttgtcctacacagcgatcaagtcgcgtatcccaattagcggtcgagtcgtcgcggggctccgggcggccaagttctttgagccatccaacggcgacaagctcacagccatacccagaaccccaggggtccgccgatcttacgaatgaccagctaagacccacgcttggaaggtaggacaagctcagtcacgcgcggatacccgaaggccccgtaccggacaaggcccggggccttcgggatatcactgagagatcaccgaatggtcgcgatgaccgccgtaaccgtggcccccagcacgctcatcacacccaccgtgaggaccagaagccgcctcatgtaatcggcgctgatcgagggctccacgggagtgacagtcagcggaggcggcgtcttccggtgccgcagattcgcgatcttgatgcgagtcaccgtgtagtgccagatcagcgtccgctcctggtcgactccgcacgcccgcaggaatatgttcagccactcggtggtgggcagttcatccccgttgagcacgtgggcgaaggtcgcgccggatatcgggtagtacttgcgactgcggcgttccagcgcccctatggtcagtcccttgtccgccaccagctcgcgcatgacggacagcacgtcctgcggagtggtgcacagcgccagcgcagtgtgcacgtggtcgaccgtgagactgctgacccgctggggatcctcgggaagacgggcgtccagttgcatgtgggcgtccatgaactgctgcacgagggtcagcagaccgtccggctgcgcggggacgacagcttccggggccgggacaggtttgcgcaggccaccgagcaggcgggggtgatgcacttcggtccgctcgtcggcgccgtcaggctcaccggtttcggcttcggcagcgcgcaccttgaccttgcccgcggcctcctcagtcttggcgcgcgccagggcgttcttgtgcaggcgctgccaggtagtgaggtcgccggtgaagccgcagccgcggacgaatgactccacgacctcccacttgggcactgtcttcccggatgccgcggtcgacagcgcagcggaggagtagtgagacttgtcggacaggtccttgtaggtcaggccactggagcggcggagcgcccgcagttcgcgggcgagctccgccacctccatcggcgcggctgccgggatgtccttctcaggacgcgccatgcgtgcccctaggctggcgcaggccgtgccgagcgttgcgctcgtggacgcggcgggtaaaccgctttgccccgcggtgcaggtgacggtggtacaggtgacgcggcgtcattaccgcctcggacggggatacccggggtgcggcggggtgggcgtcctgccggctgggccgggtgcagcgcgtgcatccggggcgggctccactcgcccggccgtttccgtcgccggttttatggcgagcggcacggtcgtccccaccgtgtccgttgtcgagttcacgacgaccggcacgaccgtgctcgcccggacgggccgcgtcgccgagggcgccgttgcgggtgcgtgtgacctgcagcaggagatcgccgacgacgcctgcgacgaaggcggcgaccagcgcactgaagaaggggtcggagatggcggcctgcgcggcaacgccggcgacggcacccgcgccgttcgccgtgacggcggaaacgatcagccgccgtcgcttttttcggctactgctggatggagacatctcaactcccggttcgtagggctcgtctgagtccctgtgaaggtggagatgagtgagggcgccccttgcggagcagccctccctcatgacccgccccgggaaccggagcgggcgggtgagcggcctgagtgctcaatacgtattcagttagggcgcgcttggcccgaacccgagagagggagcgccaactcccgtactcccagcagtgacccgagggtcaccgaggcttccgcgcgtggcaaacagtctgccccatgggggtatggccgtagcaccgcgtacaccccgccctcccctcttgtgaactcgtgaataaccaccctccggcgacacgggtgccgtcaagagggcgtgaaaaacgggaatctgatatagcgacaggcgccgcttcactcgcacgttcatgcggctacgtccgctttggcgtacttcattaacgcgtacgggtagcagtcaacagtctgcgaacaactctgggaaatctcatttctgcaggtcagaggtataatttggttgttggagttcttcagcggtgtcccgcgaccgctccacacgactcccatggcaagacaccatggggctgcggtcagcgccaactggccggagcagggagacatctcaaggcctgagtgctcctgcaggccccccgcagtagcggggggccaaaaaaatgccaccgcccgtatggggcctttgcccgcttcgcagcctccgatggtcatccgtgaacaaccagcggtcaattcccctcgcagaagggcagttgtgaccgatgtcaccgacgtggggcataccggtctacaccagctctgatctgctccgagcagcattgatctcctccaggcgcaatcgatcgggagcggacacgtgcgctctccggagatgtgacggcgagccctcacggtcagcgccgggtgaagtcgtgcatcaggtcggcgaggcgcctgccgggacgctggacgatgatgcaggagtcggccttcgcggtagccaggcggtcgacctccatctccagtcccccggtgggagcgccggcgaggctggagccggtcctgcggacgtacatcgcgacggcctccaaagtggcgaggaaggcgctgtcgggtgcttccgagtcgaggacgtcgtcggtgacctcgtgcagccagtgccgcgcctcccgcacctcacccagggcaaggtggtgcaggtgcaggcaatatgcggcggcgcggtggccggccccggcggcgagctgccaccagaactgggcgctctcgcggtgttcggtcaggtagagcaggcacgcgaagacgagggcgccgtcgacgtccagatggccgtcgtcggcgggggtttcgggttcctgggcgaggcggtcgacgtggtcagcggcgtcgggcttgttgaggatccaacggcacaccacggacagccgctgtccggcctgggcggcgcggaccatgtccgggttcggcttggctgcggcggcggccgcgtcggcggcgaggcggcgcagggcggcacccacatcgaagccctcgcgtcgcgtggtggggatgcgggcgtcggccaggaggtcgtcgatggcggtcactgtcctgcccctttcttgtccttgccgggagcggtcggcaggcccagccggatacgcaggcgttccttgcccttccggccgtgatagtcgacggtgcgcgagtccagtcccatgtagcgggcgatgcgtttggtggggtagccgagcaggtggcgcaggacgatcacggtgaactggcgggtgggcagctccaggatcgcctcgtacaggccgcctgcgctgttgctgagctcgagctgactgcggaccgcttcgaggttcttcgctatcgggccgttgatgaggaacgccggcgagcgtccgtcctcttcgaggcggcgggtgacgcaccggtgcagtacggagagcgtctgctgttcgaggtcaccctgctgcagcagttcgtcccagcctccgaggatctccaggaacacctggtggaccacctgttcggccacccgtcggctgccgaggtggatctccgagaagtcgtggaagaactcctggtgccccaggtagaagccctcgaagtcgaggggcagggcgggaggggcctggacgggctggccatggccgccgtcctggggcgatacgtcagtgctgacgtcgccgttgcccatacggtcctccaggagatgcgagcgccggtcctcgtcgtgaggccggcggtgtccttacgcgggccaacttgcccgcgcgagtgcccagttgcatcgggccctcatggatcaccctgtcgtttttcggggcctgaaactcatgcgaccctcggaaattgtgactctgcgatcttctccataaacggaatgtgattgcgattcaggttcacacgttcgaaggtggaccgtgagctgcggcgacagaggcacgcgtgaaagtacccttttcaagaatcgccgggctcgtggcataggtcacaccatgctcggccctgcgcggacatctcgtgaaacgcaagccatcacagatggccgtgtgtgcgcagagccggtccgccgtcacccctgggagtgacgcggggcattaaggcgccgaccggcggcccggcctgtcagcttctagcaggtgaaggcgcttccccgtcgcgcaccccccccttgatcccagacgctccgcaattgggcctgccctgggcgcgctcgccgaggcccagaccttccacctccagggggtagggcggctggcccgtgccgaacgggctgccgccaaacaacgcgcgcagcaggatgcgcccgcatacctgaccgcggagacagcacgtctgcatgcggtccgtgaacggatggcctccgaggccgaacagtggtggcaggccctgctcgccaacgacgaagacacggtctgtgaggcggtgaacaccgccttctccgacaacccggccgccggccgggccttccggtaatgccgctggcaccatcttcttcgacgacctgttcggccgttccaccccaccggaccgcggctgactaggctgaggggccccgccgggtgagtggaggccgtggcgccgccggtcgggccaacgacagcgcccgcgcacggtcctgcggtcctgcgccgggagtcgtctggtgaacctgagcaacggacacgtgcacctgtgccgacctgtcactgctggcgccagcggcgggtgacgaggttcagctcgtccaggaggctcgcgtcgtgtacgaggggctgcagccagtcgacgtcggtggggcgcaggcggtgcagtccgtcatgggtgagtgtcttcagcaacggctcggcgtgttgggcgagccagtcgtcggcgccgagatcgcgagccaagcggagcaggccgaccacggcttggggcggtctggggtgggggatgcgctccagcagagtgatgccttcggtaagcacggcctggcccggtgggtggtctgcagcgtgccacatggtgctggtctgggcctcagtgaacaggcagagcagtcgggtcaatgggtcgccgctggcatcgagggcgggtgcatcggcgccgaagcggcgtgtgatccggcccagttgaacgtgcgggatgtccgggcgtccggcgaggtcgctgacgcactgggcgaggaccaaccaggtccgggcggacagaccgccggcgctggtgaactggatggtggtcagctggtcgaggatgtcgatgacggtggccgcgggcaggtcggcggcggcgtggagaagatggcgtcccaggatgtccgcggccagcaggcgcccgtcgccggacaggctccgcagcatcagaaggagttcggcgtagggggtgccgggcggcccgggatcgttggcgggccggtacagcagggagatcagcgcatgtgcgagggacaggctgcgggtgcggtcgaccccgtggtaggtctccagggctgcgggcatctggtgcaggaccggtgccacagcatgcagcacgtgctgtgcgccgaggtcgtaggtgaaggccgccggccggtacaggccggctggagcggtgccatcgagatgctggaaggtctgtgccgtggtgtcgtctcgggtggcgaggttcacggtccaggcgagttcttgttcgggctggtgcgtggacagccccaccagtaggtctctgcggccggtggcgggatcggtgaagggctcggcggccagggcgcgggtgaaggcgtcccaggatccgtcgctgaactgcgagcgccacagcagggtgtggcggcgccaacagtcgaccgtgttgcggctgcccacaagggcggaggcacggagagtggggtgggccaagacggccagcaggagcaggttggcgctgtagacggcgtcttgctgggtgcggtgcgtgagggcagggcggtacggcacgtgggtgcggtggtgggtgtcgccgggcgtctggttgaagagactggtcagcagcgaggtcagatgctcgcgctgtgcctgggtgaggcgggtgagttgttcgctggtgttgcgtacgacttcggcccggtcggtgagcgggacgtgggagagcagcgcgtacagccggccgtcgtcgacggggtggtcgctgtccgggctggtggtgggcaggagatggcgcagttcgccggtgacaaggcgggtcagcaggtattcgccgaaggtggcgtgcaggaattcgtaggctctacgttcgtggccggtgacgatggcctgagcttcgtggatgaagaagaagcggccgaacagcagtggcgtggcgtcggcaggagcggggtcgagcagggcagccaggtcgttttcggcgtcggtggcggtgatgccttgccggtggcggttgaacatgccgatcgcgatgacggacaggcgctgcagttcgtgggcgacgcgggcggcttcggtgtcggccggcagggcgttgtgtttggtcacctggcggcgcacgaactcggtcaggagccgctcgtacaggcccaggcgttggatgtcctcaccgtgcagcaaatgcagagcgttgccggaggcgtcgtagagagcgagcatgagcagcagcagcggctggccggcgagttcttcgtgacggcccaccacatcccatgtgaggggctgcagggcgtgggtggagaagtagcggcggttggtggtgttccagacgtggagccagccgcggatgcggtcagcgtcgaagggttccaggcggatgacggtgctgggatgcggggtcagggcctggtcggcgaccacggtgcggctggtgacgatcacgatcgtggggcgtgcctggtcggcctcgcgctgctggaactgctgcacgctttgcaggtaggcgaagtggcgtgcgggatccatgtgatcggccgcagcctggagcagttcgtcgaagccgtccaggaggacgactctgacgacgcctgtgtccgggtcggtgacgtcgggccagggtgtgcggcggccggtggagcgcagcacggcctcctcaagctgttcctggacgcccaggtctgcgggcaggtgacgcagttcgacgcgctggcagaagaactccgccgcgggcagccgggcggcgatcagcttggtcagcagcgacttgccagatcccggatggcccaggatcagcagcggcgcacgggtggcgtcctcggtgagcagatgggctgcgaggaagtcctccaggtcgtcccacagcggctggacttcccaccagtcgtcacgggccagggcacggtcacctgagcggccggccacgcgaaaggcggggttgatgtagccggcctccaagtcggggatgcgcgggcccgactcctcgacctgggccagaggggcacggagttgctgctggtgcgccggggtaggggcgccgttgtcctgggcgaaggtctccaacagccgggacaacccggcgaggccccggctagatgaaacgtccggtgtcacaggctcggacgggtccagggcttcgggcgggtcttgcgtctcggaggtcaggcgcagttcggggcattcccacgtcacctgggccagcagggcttcgtagcggcgccaggcgcggtgcgcgagcttgtccggctgctggccgcctacgccgctttcgtcgcatacggtgtcggccgcgtaggcgtaggcggcggcgatttccgcacgcaggtcggcgggatgcctcacccgctgcgatcccagggtgacacgctccagttcggccaccacgtcgctggtgagatcggcctgctcgtgcccgagttctgtcgtgtagcggatgccggaggcggccacggtctcgcagaacgccgttaccagggtgaccagatcggctgcgcgcagcagggcggttcgggtggtgccgcagctggcccctacccggtcggcgaatccttccagcacggcgttcaggtcggtgacgacggcaccgtgcagcttcagtggctccagtagttctgcggccagccggtcgaagcccgtcctttctccgatgaggacgcccacggcgctgacgaagtcgtcggggacgtcggggatggtctgggcgggtggcagagcgggcggtttagcggcgcgtggccgcggtggcgcgtggtcggcatcggtttccgcctcgcggtggcggtggcgccagtaggccaggtcggaggcgagtccggccgacggggtggtagttgcccgttggtggcagtactccacgatgcgggcaacatcgtcccagggaggcagggtggagcgatgcccgttgagcagcatggagatggcggcggtgctgcggttcacggcgcgtgctaggtcgctttgctggatgccgcactcacgcaccaggcgccccagcagcttgcagaagaccgctaccggtcccgaagtctcctccacgcacccacccccgccattcacgctgattcagtgtgatctctggcagcgtaggcagtgacctgcgccaaccaccgtccgctttgggacttttcagcgaaaccccggcccgggcctgccgtccgtcacggtcgatgcgacacaaccccagccttcttcgaggagtgcgcatgtcctggctcaccgcccccgtcccggctctcgtgctggccctcgtgttctttgtgtttgcaggcgtcgtgctgcccgcggtgtggtccacacagcccgcacgccggaaggcagccgccgccgttcttgcgcagctcctccgagccggacgcgatgtcggcggcacacggctttccatgccgccgtccccgccttctgccggtcctgccacggccactcaccggcagacgcaggtccagccacaccactcggacaacgacgcgcaggacgcggcatcgtgagcccgctgcatggagccagcccgcatcgtccgcgctcggcgtgccggtgggatgtgtctcctcggccttgctgtcaccggccggcgcgctcacgttcgaagcggttcggaacgcgtcggccggggcgttccgaaccgccggggtgtcagtcctgggtgacggtgagggtgcgctggtcgaggtcgagctggacgatgccaccgttgtgatcgcggagctggcgccaggcggcatagccggtgaggatggcgtgttcccagtccgcggcacggcagatgctgacctcgaggtgggcggtcatgtgaccgatggtggcgaggagttcctggtcgatgtgcttgatgtcggcgaggtagcgatggcgggcggcgtacgagaagacgagggctgagatgccttcctcgatggcgatggcgcggccgccgtcttcggcttcgtcggcgcgggggtcacttttgcgtttgcggcccagcaggaagcgggtgaccggggaccagcccagcaccgtggcgtgggcgaggtgaaagatgtcgtggaagcggtagccgtcttcgacgtgggaggcgctggtgagagggtcaccggcgggggtcccgtcttcccgcgtgaggacgatgacggtgcggccgtcgtcggtcttggtgggcgtgaaggtgagtgaggtctgccggggcaactgttcgtgggcggggaagccggcgtcgaagggggcgtgctcctcttggggggtggtgcgccagcggtctttgaccttctccaggttggcggcggctacgtcgtcgaggtcgagtccgaagcggtgggtgagagcggcgatgtaccacaggacgtcgccgagttcttcgcgtaactggtgttttccctgttcgaaggcgggtccgtcgcgcaggaatttcttgtacgcggtggtcagggatccgacttcgccggcgagaccgaggagagggacgaggacggggtcggtgccctctgcggggggttggagggttttgatggccgcttgctggtagcgcttgaagtccacacgcacgcctgtctgatcttgggacagccccgttggctttcccgacagtgtgtcgtatgctacgacagcgccgttggatatgcagacgattggggagagttgtcgaacacaggcacaccgagcatggacgacatcacctcggtcgtcatcgacttcctcgccgagtacgagggcgtctcccccggcgagcttcgctccgaactggagcaggacgggcgggagttgcccgtggactccctcttggtggtcgagatcctcacgcgcatcgaggagcgttaccacgtcgccattcccgcagaccgggaagcggcccaggcgaccgggtcggtgcgggcattcgccgcggcggtcctggacgcgatcgaagaaaggcagcagtcatgacccctcccctctccgacaaccgtgaccgcgatcccgagctggtgcggctcggtgaacggctgaagaagacccgcgactacttgaacatgtctcagcagttcgtctcggactccaccggcatcccccgctcggccatcagcgacatcgagcgcggcgagcggcgtgtggacagtctggagctgaagaagctggcgcgcctgtaccggcagccggtcgcctatttcctggccgaggagaaggacgcggacgccagcgagtactcgctggccggtctgccgcgagcgctggcccagctcaccgacggggatgccaggaccgtgctggagttcgccgagtacctcacgctccggcgcgcggcagaacgcgaggatcagaacgccgagggcgggagtccgacggcgtgaactgggccctggcacaccggatcgcttcgatcgccgccgtccagacgcaccgcgacctcggcatcgaccgcacgcagtacgtccacgtgcaccgggcgctcggggcagcggacgtgatcgggatggcgcagccgatgccccggctgttcggcgtgtacttctcccccgccgacaagggaccagccgtgatgctgaacgcttcgctgaacgcgatcacccagcggcacacggccgcgcatgagctggggcatcaccggctgggccatcgcaccgcggccgatgaggagctcgatcccgcgctgcgctggggcaacggcagctggcccgaggaggagaagacggcggaagcgttcgcagcatggttcctgatgcccctgccggcggtgcgggcagccctggagcggatctgcggcagccggccgtcgcatcccgagcacgtctaccgggtggcgcgcgaactgggtacgtcgtacgccggaaccgtacgccatctggtcaacctccggctcctcgatgccggccgggctggccagtggtccaagatcgctcctgccgacctgcgcagctcactggcggccggggcctcgctacccgggcaggcccaggtgcacgtgatcacagcagcctccgcggggcagacggtgcacgccgacgcgggcgatgtgctggtgctgcacctggacaacgcgctcttcgacgtcctgcccaagggagtggagccgtggaccagtgacggtacgacgccgttggcgagcgccgtggtgaccgacgaacttccgccgggcgaacagggcttgatcgaggtcgcggtgccgacgcacggcgccgcgctgcggctgactgtggtgcgcgaagccccgcgtgccggggtcgacgagacctggcccgcctgagcccgactccccggaccacacccgtatgtgtcaggaggactgatgcacaccttcaccgtgaccgaacgcgacgtcacccaggcctgggtcgccgcctgcaacaagctggaccgcaaggacaacccggaccggaccggcctgcacacggtggtgcgcatcgccgacccgacgagcgacgacccggtgttccgcgccgaactcgaccggctgcgcaccgctcgcgggctctggccgttggagaccgtggccagcaccctgtttcccgcggccctggcggcacggagcgccgacccggatgacctcgccgagcgctaccgacggatgtatccagtcatcaagcggtacccgggcaaccaccgcggcacgtacttcggccgcctggtgttctaccctgcggcgtcgaagaccggcatcgaccagctcagcaccgtcatcagccgactgcggacacaggccgcgggcaccaagatagccgccgcgtacgagatcgacatagccgcagccacggaccaggaggaggctggcgcggatctgctggtccacactgccgggaaggacaacagctacatcggcttcccctgcctgagccacatctccctccagctggaccgcgaccggcgggtgcacgccgcggccctgtaccgcagccacttcatgttcgagcgcgcctacggtaactacctcggcctgggccgcctgctggcctacatcgcccagcaggccgaactggcctgcggaaccctgaccgtaatggccggccacgcccggctggacggccccgtcacacagctgcgcccgctgctgaccggcaccagccgcctcgcggcataacggcagccggcgcaaggccaccgccgtcgcatgcggcacgctcagtgtccgggcgggccgttgagctgccacttgggcgggaaccaggccggcatcgcgtctgcctgctgccggtaggtctgcttgatgcggctgcggccgctgatcccggcgatgtccgggtgggcgacccgggcgtacttgtcgacctcgcagaacaggttctggcagtcgatcagctgcagcggacgcccgcgcagtcccgcaaaagagaggcccaggcgggcgaagtgctcgtcctgggtgtcggccatgtagcggatgacctccgcctcgatgccgtcagccgccgacccgaagcacttgcggatgccgtcgcgcgccccgggcccggggacgacgaagtccatctccgaaaacggcatctcggccgcgtagttgaggtcgatcacgaactggtaggccaggaacggcccgatcgccgggaagcccagcagaacccggtaggcgccctccagcgtcggcgcggacagcacccgctgcggcgcgtccgcggtcatcatcatctccagcagccgcaggtggttctggtgcttgcgctcctcgccgagctgcggcgggggcacgatgtaggcggccgagtacaaccgctgcccggcagagaacgcttgggagagcacccggtcataggtccggtagtcgtaggcgttccaccgcacctctcccagcgcgccgttcagcagccgccatgtcgaggtcttgttgaagatcttgaacagcagggtccggaagaagacttcctcccacgcctgctcgccccggtagatcacgccgccgatcaggtcctggctgacccggtcggcggccctgaagcagttggtgaagcggtgtcgctgcagaatcggatcgtctgtgaacggccccgctcccccggccagtcgcgcctcgtagaccttctgacgcgccgccgcgaaacgccagtaggtgtcgaacaccggcgtcaccgtcagcgtgcggcctgccacacggatcttcctcgccgggccgcagtctaagaccctctgctctgcacgctcttgcagcaccgtcaccatggggtcaatatatattcaatatagattggtgtcagcgagggggacgtgtggaattgctgtggcagtgtccacgacgcaagacgctggtcgactggccggaggacgtggacacgaggctggacgtcctggtccgggccgcggcagcggccggggagcagacgtcgcgttcgcaggtgctggccgcactcgtgacggcggccgaggtccgtcccgccgtcatctccgaactcctccactcctaccgccagatgcaagccgacgccctcgaagcggacaacacgcgcgccgacttgccgtccgtacgctctcccggacgcactcgcggcaggaggtgacgccgagtcagtcccggtttctcacccgagtgcctccggtggcccggtcaacgccatcaaacgccataaggtcacggctgcgtgcgccgtttctcgatgggcggccgatcagatatcccgcagacctgggccgatcactcaaatgccctgaccaccgtcgccgaggatggagctaaatgggtctccaggatgacgagctcggcgcctggtgcgctccgggcggcgcggtgcctgtacagggcgagacgacatggtcgttcctgcatcgtgtcgccgtctgctacggccttgaggtgggcgagctgctggcgtgggggtggtggcagtgggtgaatccggtcacccagaggcgcggccgccgtccggacggcgatgtgctcctgaacgtcacagcccaggcacaggtcgcggcgtgggccggggccccagttgcgcatctggcgcgggcattgccgtcgtggacggccggcccagcgtccttcggtgagcgggcccgtgcggaggaggatgggcacggtggcgggtgggagctcaggcatgggggccggtgtctttcggctgccgtccgtgtgccgcccggcgcagcggccggatgcagcgggtctggaggtacgggcaacggtggaatcgggtgtgttcccggcacgggcggtggctactggatgtcggcgatggccacgacctggagtatctggacgtgggcgggtgccaggagctggctgccgcccaggcccggtggccgcggacggcccggcgggcggcgagcacgggtgcggagccgggggctgtgttcgcagtggcgcgggcggtggtgtgcgggtggtggcagcaggaggcgttctgggagcgggagcaggtgtggagtcagcgccttgagcggatcactctcgacaccagccgcagaagcgaggtggcatcggagtggccggcagcgtggtggcagctggtcgcgcgcgacgcggttgtcttccccgaggtggtcgcggtggcggcggcattggtggatccggccctgcgactgctggtgacggatgaacggccgcttgtccgccggtcccggcacaatggccgtttcgtgaccgcgctcggagagcggctggagcgcggctggctgggagaggcggagttgacagagaagcctagcgccctgcaggcatggatgaggggtctggcccgcgaggtccgctcgccgtcgctgtctggttcggcacgccgtgagatgtggcgggtgcaggcggcccatcagcctgcggaagtgggggcggggctgcgtctcttggctacctcccccactcgccttccgactgcacgccgggtcgacggggtggcgggccgagctgtggctgcctcggcgcgtggggcagggcgccgggttgaaggccgtatccgaggaacggttccaggatggtcttggtcacgcgcgcaggtatgtggcccggcatgggcatctggccgtcccgcacgccgacgccccgcaggatgggttcgacctgggccgatggctggcgaatctgcgcgccgcttctgccggcttgccgcctgagtacgtgcgggtgctggcggaactggacgtgtggtggaatccgccctggccgatcagctggcagcgggcctggcaccgggcccgtgctcacgctctcgcccacggccccgtcagcggtggtgacaatctggcggggttgccgcgctggcttgagcggtggctgcgccgccagatcgccgagtactcccagctggccgcggaacaacagcagttgcttgcccagctcggcctcacacccgccgagatcgaccgcttccacgcctggcccgcgcgacgccgcagcgtgatgcatggcctggaggctactcacgactatgccgccagccatggccacctggccgtctcccagctcacctcgcacgacgggttcgccctgggcaagtggctcaaccaagtgcgccaccgccagcgcaccgccacccagcccacgcgtctcggccggcagctcactgccctggacacctggtggaacccgccctggcccctggactggcagcggtactactgggccacgcgccatcatctccacggcctgcccgaaggcgtggtgtggtggcccggcgcaccggaagaggcacagacccagcagtggctgcacgagcagcaggcgtcctggcagcatctgcacaacgagcagaaggcgttggtgggccgcctggcaaccgatcagtcgacgggtggctctcccaggagcgaccgaccggactcatcgccgctgtccagctgatcgaggcccacctggtctctccccgcgatggcccttccctccaggcatcctccgcagaagtgcctcgcgggcgaccgcaggacctggcgtggcgccagttcgtccggcccgccgccgttcctgagccggtcgtcctagccgctgcgtacgctgcacggatgacgcaagagtggacctcagccatgagtttctcctcgttcgctcctccttcaggtgggcaggacgaggcggcacccgtcgacccgcgcgaggccgtggaggcggtagcaatgcgctggcaggccttcagcagtcgcggagcccaagtgggctgggcttcgcaggagagtctgaggcaggccggcgttacgggctacgggccgctgatcaaccgggtggtggaaatccacgggctgatgggcagcatcggagaacaactcgccctggcccgggccgcggaacaggacgcacagcgtcaccaacggaccgccgccatccatgatccacggcaagcggccgtcctggagcacagccggcggatggcggtgcgcgccctgtgcgagatgagtactcatttcgttctcggtgctgcgcacgggctggccaacctcgtgctgcggaccgttttgtgccaccccgctgccgcttacgaggtaaaccaggcgaaacggctgaagaaggcgcagggcttccctccgggcaccgatctcaaggaggcctggctgacgttctcccccacaggcgacgtctggtccacgttgctgccagcagcagccgaggcaagcggcctcacctcgctgcaggaccttgtggcgcggctctgcctgctgcaagtcgacccgaggttttccgcgttggaacaacggcgcggcatggactaccaccgtcaccgcccgcagtctttggaccacacctcaccgcgcgccggcctgtggtcatacgatcccgttcacaaggtgtccacgatgcgcatgcctggcgcctcggcggacgccgagcgggatgaggagaccgtccatcgcatcagcgccgacgcgctggagtgcctgggcgcggccctcaccgacatcgagcccctgatgggcgagagtctgcgcagctgccatctgtcctggataccagtcaacgcctgacaccgatcgcccaccggcggcgtgcaactggccgccgtctacggcgcggcgcacaccctaggctggccaagtcttcgccgggtcacgccttttcgctgtcggcgcccgggggcgtgtacatggccgaaagagagagtcgtgtggagtctaaccctgcgccgtcggcgccaccttcggttgaggcctcgggcgagcgcgctatcgcagtcggcggcgacgttgaaatcgccgtgactggtgacaacaacatcatccaccactatctgatcttcggtggtgtaggcggtccggcgggcccgacgcgtacggacgaggaggccccgggctttcccgccgccaaggtcagggtcgtcgtccctgtgctgatcggcctgctcaactgggttggccaggctgcctcggtgcatcccggtcggcgtctggtgcagtcctatgtggaacaggctttgcgccaggttggcagtcagggactggtggcctacggagaagagcaggacaacgacgagagcctgcttctgttcaccggggcagcggacatgcgcacggtgggagccttcctgctgtccgagctggatcgcatgatggctgaggactggcccaacgtcacatgcagcaccggctatctcctgccgcagttgcggcttgtcctgcacgcgggattcggcgaatacgacggctcccgcatctccagtccgtccttcgtgaaaaccatccggggagctattgtcaagacttgtggatcagtgatcagaaccagttgatcgtgtccttcaggaggcgggcgaacttcgccctcctactcgcgttcgctcgccaggtttcctcggcctgaacgctggcggctatgactccagcctggccagcccggttctccgccggtatcagacggcggttggcaatgagcatcccaacccggatgagtgtgacgcccaggcggcgggcggcttctggctgggacatccaggcgtcgtcctcgacggtgtccaccttgagcagaacgtagccgcggttgtttcgcgaccaagaccgcccctcccgacgtcgttcatgcatcacgctgcggccgtcggtcgctcgaccaggaggccgcgttcgaagtgggctccggcgcggacgagggcgacgaggtggggagcgttcacggctcgccaccgctgctgtgcggactcgacgagcttgaagaccatggccagggcggcggccggactgccggcgccccgggcgaccttggtccgcagacggacagtggcgaaagtcgactcgatcgggttggttgtccgcaggtggacccagtgctcggcgggaaagtcgtagaacgccagcagctcgtcgacgtcgtcggtgatcttcttgaccgccttggggaacttcgcgccgtaagtcttggcgaactcggcgacggccttgagcgcgtggtcgcggtcctcagcgttgtagatctcctgcagggccttcttcgcgccgggctgggcggacttcggcagggcgttcgcgacgttggcgatcttgtgaacccagcacctctggagccgggcctcggggaacacctcggccagggctttccagaacccgagcgcgccgtccccgatggcgagggcgggagcgcgcatgccccggcgtgcacagtcccgcagcaggtcggcccacgagtcggcggattcgcggtaaccgtccttcacggcgatcagctctttggtgccgtccccgcgcacgcccaccagcacgaacgcgcacgacttcgcctcccgcaggcgtatgcgcaggtgaatgccgtcggcccatacgtagacatagtcgctggcggacagatcacgctcgccgaacgccgcgtgatcggcctgccattgctgggtgagccgggtgaccgtcgccggtgagaggccggccgtcgaaccgaggaactgctcaagggcgggcacaaagtcgccagaggacaggccgtgcagatagagcaggggaagcacctcgctgaccttcggggacttgcggcaccacggcgacaggatcgccgaggagaaccgcttgcgctcgccggtggactcatcgacgcgcttgtcgttcacccgcggggccttcacctcgacggccccggccacggtcgtgaccttcctcgcctggtgatagccgttgcggacaaccagacggtgctcgcgctcatcccgctgatcggccaactcggatatataggcgttgacttcagcttccagtgcggcggccagcatccgcctcgcgccctccctgacgatgtcgtcgatcagggaaccgtgtgacgtcgttccctcttcgttgactaccgtgagcagtcgggtagctccggggcattgctgcaccggagccccctcagaaccggacgtgcgagtcatccccgcatccggctcaagctggcctgtggccgccggtgggcgtcatacttccggtcgccagcgtgtgcctggcgatgacaggtcgtgtggatcagctccaggttgctcgggtggtcgctgccgcccttgctgcggtaggtcagatgatgcacgtgaatcgcccggaggctccccgtgaaccaattggcccagtcctgaacgtcgtccgggtcgaacccgactccgtcgatcagatccagtccgcacctggggcagagcccccgctgacggtaggcgagggagaggatcttcttgggctctcccacggcctgtatccgcttgcgtcgacggttcccccagtactcttccagctcctgatcatcgggcgacgcgtcgtccttgaccaaggtgtgtcgctggatcggcatccaggaggcttgcggcaagtagtgctcgggggtgccgaacacccacttgctggacctgcctggctggaacgtgccccagtacctccgtttgatccatccccagggtttgcggcgatgccgtcgcatggcccagcgtttcaggacctcgaaggtgtgggcgtccagtaggttgaaggtctccttcgaacagacagtccggtagtacgtggaccagccacgtacgaacggtgacagcgccctgaccaggctttcagtgggcgagccgctgttctccctggccgtggtactgatcctcttccgggctctctgcagggcatcccggctcggcttgatgatcagtttctggcggaacctgccgacgttgaacccgaggaagtccaccccgctggagaggtgaaccaccctggtcttctcctcgttgaaggagagaccacggggttcgagccatgcggcaaggtcctgcttggccttgatcgcctcgttctccgtggtgcagaacaccacgaagtcgtcggcgtatcgaaccagagtcggcgaggtcgtcttggcgttccaagggcggttcgccccgatgacctctcccatcccatggagtgcgatgttcatcagcagcgggctgatgacgccgccttgcggggtgccttcaggcgttgagacgaaccgcccgtcctccatgaccccagccctcagccattgctggatctgccgtcgtcccggaaacaggccgacggagtccatgaggtgctgatgactgatgtggtcgaaggcggctgacaggtcggcgtcgaggacccatagtcgcttggcggtcctccgcccagcgacattgaagatcatctctatggcgtcccaagctccccggcctggtctgaagccgtagctcctggcctcgaacctggcctcccactccggttcaagagcgttcttgaacctggcctggtcgacccggtcccggatcaccgggatacccagagggcgcctcttgccgttcgccttcgggatgtacacacgacgcacaggctgggggtgggacatggggtcagcaagtatctgccgcgccgtcttcccccgcttctccggagacaaagccttctgcccatcgattcccgccgtcttcttgccggtgctgacctggcagacccgcctgacactcgtcaacgtgttggccctggaccgccgcatcagcttttgcaggttgcgcacctgcttcatgtcaccctcgcgggcagccctgaaaatcctctgacgcagccgctttacagacgtctcttctcgactccagtcaatgctgtgccagaactcggtgtcgccctcgggtccgttcatccggggttcggcgatggccagttcggtcaccgcagcctcccttcagtccaacttgcgcctcggtacaagtgcttgcccatcgtctcttcatggcctacctggtccacgtcagccgcctttcggctccagccacaggctggtgtccaccgggttatgagccgccaggtggggactcctggtcggcggccgtttcccctgggctttcgccctggtggcgttcgcttcttggaccatcctgttcccgcacgggggttcgacctccgttaccttcggcttaccggctgacgaggccggacccgtacggggtttccgtgttccacatcgtgcagttgcgcccgggtggggtgctccctttccgccgtcctccgcggtgacctacaggtcccttcccgatggggacctgccacgccgggcttcccagccctagtagggcttggtcatcttcacttgcgcatgcgtgtctactgctctgtgagcgtcgttggagtggtgtgacacctgaggagatggcctcggtccgggaggatcttgaggcgttcgcggcggagttgttcgacgggttctttcgtgcggatcagcggcggtgggggcaggcgtatgtgcgggggcttctcctggaggggcggcgcaagtcggtggagccgatggcggcccgccttggtgaggacggcaatcgtcaggcgctggcgcacttcatcacctccagcccgtgggatccggcgcatgtgcgggcccggctggcctggaggatgcaggacgcgatcggggcggaggcgttgatcgtcgatgacaccggctttgtgaaggacggggacgcctcggcgtgtgtgtcccggcagtacaccggcaccgcgggcaaggtcaccaaatgccaggtcggggtgtcgctgcatctggcccgggatcacgcctcggccgcggtgaactggcgcctgttcctgcctgcgtcctgggatccgatgtcttcggaggcggacccggacaaggtcgcccgccgcacccgctgcggtgtccccgaccgggtgggccatgtggagaagtggcagctggccctggacatgatcgacgagacccggtcgtggggcatcgacattcccctggtcgtcgcggacgccggctacggcgatgccaccgccttccgccacggcctggaggaacgcaagctgccctatgcggtgggtatttcctcccgccacaccgctcatccggccgacgcccggcctgtccagcccgcctatgcgggcagcggacggccaccggcaatgcagtatcccgagcctgcacagaccatgaaagacctggtcaccgcagcgggacgggcggctgccagggcggtttcctggcgggagggctcccggcccggcaagtcggtcagcggcttcaaacgcatgcactcgcggttcgtggccctacgcgtgcgacccgccggacgcggggtccgtcagagcaccgacggcccggagctgcccgaacgctggctgctggccgagtggcctgctaccgaacccgaaccagtgcagttctggctgtcgaacctgccctccgggatgccgctggccacactggtgcggctggccaaactgcgctggcgcatcgaacacgactaccgcgagatgaaacaggccctcgggctggcccatttcgaaggccgcacctggaacggctggcaccaccacgtcaccctcgtctccgccgcccacgccttctgcaccctgcaacgactggcgcaagacccaaaagacgcggcggaggagtgagcctctaccaggtcatccgcgacctgcagacactcctcgctctctgggccggtgcctgccccacctgccaccgcgacatacccaccccactccgaacctgaccaagccctactagcttggtctttaacatccggcgtcgaatggtgcgtcgaacttgatcactcggttcggtaaccggcgtacacggaaacggccttcagctgaacatgtgctccgaccaaggaacacacacgtccagcacgaaggccgtgaggatgagtctgctgcatcacgactcccgatcggaggcattggcgcaactgtcatgcttccggggcgagttctactcctgtctgaccgctcgttcggacgcgttgttcgagctggccgatgccgttctgtgtggcgacggaccggtgaggtcgctggccgagctgtcgctggtgggtgaacaccgccgaggccatggcggcctctacgccgccctggcccgtggacgcatcgatgccggccggctgcggcgggcactggccgaagtcccactgccacgggctgccgacggccggctggtcctggccgtcgatgtcacctgctggctgcggcccgacgcccacacctcaccacagcggatcctgtgccacacctacggccggggcaaggaccagcacatccccgtccccggctggccctattcgatcgtctgcgcgctcgagcccggccgcagctcatggaccgcgccgctggacgcactgcgtctgacgcccggggacgacaccgccaccgtcaccgcccggcagctgcgcgatctgcttcagcggctgatcaccgcggggcagtggcagacgggcgacccggacatcctcatcgtcgcggacgccggatacgacgcaccccgcctaggcttcctcctgagggacctgcccgtgcaggtgctggcccggatgcgctccgaccgcgtcctgcgcagggctgtcccaccccggctgccgcacactcagggccggccaccccggcacggcggcgagttcgtcttcggacagcccgacacctgggacaccccggacaccgaaaccgtcaccgacacacgcctctacggccaagccaccgcccgctcatggaaccggctccaccccaaactgacccaccgttcctcctgggcagccgccgacggcaccctcccgatcgtcgaagggacggtcatccgcctggacatcgcccacctgcccagcggagcaacacccaagccggtctggctgtggtggtcaggcaccgatgccacaccggcggacgccgaccgtctctggcaggcatacctgcgacgcttcgacatcgagcacaccttccgcctgttcaaacagaccctcggctggacctccccgagatccgcacccccgaggcagccgaccggtggacctggctaatcctcgccgcctacacccaactgcggctcgcccgcccgctggcagccgacctacgtcggccctgggagagaccaacctcaccggacaggctcacccccgcccgagtccgccgcgactttcggcacatccgcccacaagccgcctgtccggcccaagcaccgaaacactcccgccccggccccggacggccaccaggccgaaagaacacccggcccacaccccgccacgacgtgcacacaccgcgcaaaacaccatcggcgaagcagcgaacgaagaagtcaaccaccccacgaccccgccgcacgggttaaagatcaagctagtcgaggcaatggtcgaggtcgtggcggacgggcgcgagcagctggtcgtcactggcagcaggtcgcgggagaaggcgtatctgttcaccggggaggacctggccgcaatcagcccgtacctgaccgaccacatcatgcggttcggcacctacgccaccacggagctgaccgcgcgaccggtcgcgttcgacccgcacctagacgtcgagttcgagacggaagaggaagtaccggctgcggcgtaaagagccggacaacgagctggctctgtttgtcccttgccgcgactacctcttggtgtccctcgtcgactgtcggctggagagggtcacgacgtgggaggtcccaaggaccttgccctgcgcattaagcgcctttacctggaagtacggtccgggggcgttcgtggtgatggctgtctcgaatccggagcgtggggcgcgtctgacaacgaccgacagggagtgggggtcggatccggcgagtacccgccatgctctggtctgcgtcgagccgttccaggaggcgtagacgacgctgtgtccgccgtcggaccgtgccgcggtactcggtgggtagtacggcgtgccgatccattcgttccggaacgctcggtacgagatgttggagcccggcagcttcgcgtcgtagagcaggttctgcaagccgttgccctgggtgttccccgcacccgcgtactccgagtagtacgggctttggccccatccgatgaattcgttgccgttggaaagggcctgggtgtttccctgggtcggtgactccagcggcggctggtggtagtaggtcctgtccacggttgccttccggctgcggacgtcgaggttgaggatcaggccgtgcgacacctgttcgggggtgccgtcgggaaggtcgcagcagccgtcgtcgaacatgctgatccggtttcctggccggaatcgggcatcgtgctgccagtagaagtccgcgttcgggccgaaggtgaagtcgctcttccttcctccgatctgatagcggatccttccggatctcttggtgacgtcgtagatcgcccacatgttccgggccgagatcagcagtcggccgtcaggaccctcgtcgacggagttgatgtgaaaggcatcccagaccccgtcggacgacgacgcactggagaccggctcctcggaatccgcggggtcgaggtggtctagtgcgttccatgagaagaggagtctgcccgtggcgaggtcgacctcctggatttcgctgttctcgatggctccgttcttcgggcctccgtagggggtgagatccatgggcacgggcttggacgcgatgaacagcgcggtgcccctgcgggtcagggtgaattcgtgctcgtccgggtagcagccgtgatgcgcgaagaccgtcttgagcaggcggtagtgcctgtcgtagatgtagtagcacccgccctgttcgggcgcaccggccggcaggttcgtatacgccgggggaagcgcgagggtgccctgccaccaggtcagcaccggttgtccccggtccctgcggccgtcgtaataggtctggaccttgaagtcggcgttctggaggttcgtggagggcagtgggcggaaccacaccggatcgccggagttgtcgttaatcagtgctccggtctggccgaccatctggtccgcgctgaacggggcgacgaagatgtctccgcgcgccgtccccggtttgttcgcggtcaccttcacccgcatggggtgaagggccggatcggagacgaaactccacacatcgctgcccgacaggatcgggggcggagtgctttccgatggggggaagggctccgtcgcgcacaggcgggcgcccccttgcgggctcgccgaggccgagggcacgctgcttgtgatgacacaccccgcgacgagcaggcaggccccggcagtacggcgggtccggcttcgtgtccggcgaacccgcagctctcgcgtcgccattaccgacctcctgggcatccgggcaccccttctccggtgacggtgccgctaagtcttcgaaccctctgtccggttcacccctccgacccggaatggcgaagatcgggagttgttcctcgggtgacggtaagcagcaaggggcctctgcgcctgcctaaagcactcaagtaggccattcggcaggcgcggactcacccgggtggcataggacagcgccgtcggaggacccgccaggcgttttggcgacggtcaacaccggatccggcacagcaacccgaatgacgcaccgaaccggccctcggcaaacacgggccccccttgccgcatacgttcactaactgatgagcacgcggcctcgccgtcttgagcttgcccgctcagcgagcggtcctactcccggcctcgtccgggggcgggccgagggtcggcatgccgaggtcggccggtgccggggccgtgcggcaggacgccgcccggcttcggcgccgtacgaccaggacgccgagtccggcagccacggccagcaccgccagggcgggcatccacagggcgccgatcgcggaggtgacgccgatgccgccgaggacagccaggatcgggcccgcgcagcacacagcgcaggcggcgagcgcggccgcgccagcgccgagcgtgccccagggccgggacgggcggggagaggatgcggtcatacggtcgctccgaagaggtccgccagcatcccggcggcggactcgggggcccgcacctccagctggagagcggccggagtcaggtgcagggtgaagtcgaagaacgcacagcagccctgttccgccgcggcgagcgccgcgacctcgccggccagctcggccccggcagggaaggacaggcgtactccgtcggggatctcctcgcgctcttccgccttgctgaccagctgcttccactgctcggtgcgcacgcccagctctgcgccgcccaacgtgcacgccaccggggtgtcccgccacggctcggcgatccggctcgggcgggtgggcgacaacgtgatcggtacgggcccggccgccaccgggctggtcgtggtgcagccgcagtccggaccgcacgcccctgagggcgccggccccgacagctcggtgtggacaccggccaggtgggcggagaacgcgcggagctcggcgatccggccgtcggtctccgcgatccggtccgcggccagcggcagcatccgcgctcgtacggacgcacacaccccttcctcgcggacgtcgaggagctcgcggatctcttccagggccaggccgagcagcttggccgaggagatgaaggccaggcgctccaccgcgtcctcgccgtacacccggtacccggacggcgtgcggtcggcgggcagcaggccggcgtcctcgtagaagcgcagcgtcgtggccggtacgccggagcgttcggccagctgcgagatgcggtaggtcgtcacaccgccgacggtaaaccttcgacccgacttgaaggtcaagtgccggcccggccgagcaggggctcggccgggcacggatcagctgggcagcagctcgtcgacgagcgcgcggacgcgggtctcgatctcatccccgcctctcgtcgaaggcgaaccggtcctcgtccacgttggtctgaactgcccggcgctcctcgtagcgaagagatatcgcggacgctgccgagaggtcgccggccggtcaccacacgtcgacggaccagacgtcgcccctctgatgtccgtctggatctgggtcgcctgacccgtacgggtcagggtcggcgacgacgtggatgcgggcggcggacgcggatacgcggtagcagtccatgtcactcgaagtgttgtgcttgtcaagttcgatcgtgcggcccagggccaggatggcggcctgcagttgcttgaaggggactctgggtgcgaattccccgtactcccgcgagagcggggacggcacggtgttcggggactggtcgtacagcagccgttggatcttcacgccgaagccgaagcacgacatctgcccttgccgccctggctggtccggcgagaagttgatttccacgagcccgtagtcccgccgcagtaggccaccaccgggaacatcgaggcatgtcgcccccagggcagcctcccaggcttccgggccggcaccgaggccaactccccggacctcaccgcaaacggcgacgtgagcgtagaagtccaaagcggacacccgccagctccctcaactatccggacaggacaccacttgctgatctccgcacaggacaggcggatcagtgcccagtattcggtgatcgtacagagcggccagtcatgacagtcgccgggtgagttcgtcgccgtcgtcgaagtcgaagtcccaggcgggatgtgtctttcattcccggtcaccccgggcatgccgatcatccccggagaagcaccatgagccccgcctgccccagagaatgctggcgtcaagccgatgtggagtcgccaggatcgacacccaaggcgctgcctgcagtgaggttctcgacgaacatcctgaagtcactcgcgagtgcgagttcggtgtcgagatcggtatcgaaccaggtgaccgatggctcaccgttcgggccacaggctcggtagtcgagactgatccagcagtgcccgtcgccagagagaagcacgatcggcgatggcagctcccactctttgaccaagtagggggtgtcgagcaacgatgtcatccgctcgcgtcgcccgatgcccatcagatcttcgaagggaacgtggtcttcgctccacgaagtgggtcggttggtggggaaagcttcgtcgcgatggcgtcaaggtcgtcctggctgaacgtcgacaggttcgtgcctttgggcaggtactgccggagcagcttgttggtgttctttcagtcgcagaccgttgtgatgattgcggtgtgcgggttgctctactggggtcggcggccggtgatgtctgcgccaggggtatcgggcagggcgatgcgggcagtgatgcgtttgccgaccggctcgcgctggacttcgaactcctgggagatggccatcacgatttccagaccgtgctggccgatccggccggggtcggcggcgcgggccacaggcaggacggggtcgctgtcccagacgacgacttccaccaggtccccggcgaggcgcagttgcatcaggacagggccgggggcgtacttgcgcgcattggtgaccagctcgctgacgaccagctgggtcaggtccatggcgcgcgcggacaccggcacgccgtactcgctctggacgcgggtaaggaattcgaccgcgagctggcgggcttcggcgatgcaggagccgtcgccgtccagggccacggcggtctcgatcacatcggcgcccggcatgacgtttcccgcactgccgggggctgcttccacggctccaccctcagtcccctgtgttcacgcggctgcgtgacgtgtaccccgccgcctgccgcacatgcgcgctcggtgttggaggaaagactgtataggtgtacctcgccaggggactggggcagggtgggtgcgcacgcgttgtgccaggatcagagatccccagtcagcgagcccagtcgaggaagttgtgaccgacacccacgaagcagcacggcccggcctgtcgatcgaccaccaggctgtcgacggcatccggatcgttgtcctgcgcggcgagatcgaccacgccaaccgcgacagccttcacgaggctctgctcatacccgaaggggaggccgagccccggaccgtggccgacttccgcggcgtgacgttcatggactccagcggcatcaacgtactcatcaccgcccaccgggccgcccaggacgcaggcggctggctacgcctggcaggcgtgcaggaacccgtacagcgcgtcctggcgctcgtcggcatcgacaccctcatcccctgccactccaccctcgaagaggccctgaccagctgaaaacccatgctgcaagctctcggcacgatggaggaagccagcccccggtaatgaggaccgcaccggcaggaggttctcctgccgccaccagcgcggcggcgagctgaccgcacggccgcctcgcgctgacgtccgggggggtcccatgccgtgcgaggctcccgccatgagcaccacgcgacgccggcttggcaccagaccggacgcccccgccgccaccgccaccgccaccgccggcggaaccgaagtccccacggctgctccccgtcgaacgcatcgagccggacccggcaggcggcgacccagcaccaggccgtggccgaccggacaggcgatgccaccattgggccggaccctgaagtccggccccctgagcggccccaggccaaccagtcaaggggaggtcccgggctcctgctcgcgctcgcactgccgatcctgatgagggcggcgctctttgccctggatgccttcgaagaccgtctcttcccgccccccgcgcctgcggacgacgaaagccttgccgccgacacaagatcgctcgccctgacgacgtctcccccgcgcccagcgcggccaggctcggacacggcgagggcccggcactgcgcctatgacgctgttggcgaatcgcctgcaggccagtggcacgagtctcgtctcaggagctgagccatgacgcgggcgagattcatccccccggggtgagggcaggggaacgaagcggatttcgccgtgccggtgcggaaaaaggcaagtgccggggccgcttcgttgggctgtggtcggcgcgcgtcacatgtccgcgccatggcaccgacgttaggaagtgggaccggtggcaacaggcacggtgaagtcgttcgacgaggacaaggggtacggctgcatcagccaggacgatggcggcgcggacgggggcgtgcacttctcggtcgtccagagcaacggattcaggaaattggagaagaaccagcgggtggggtacgaagaaccatggacatatccggcaccgacacgggagattcccccgcgcccggcccccagacgtcctctggcgccctgcttggtgcaacgctggaggacgtgcagacggctgtcgttgccgtcgatgacgatggactcatcgtctcggccaacggcgcggcccagagcatgctgggccgcagcttcgaggaactcgtcgggcaggacttccacgacctgctgcaccgcgacagctacgggcatgccacgccccgcacgcgctgtcagctgagagacgcgcttctcgccgggagaaccgagcacggcgactcggagtggttcgcccgcggggacggcacgctcgtccggctgtcctggctcgtcgcgcctttctcctccgagtcggagggggcgggtgcgctgatgctgttgtacggatcgaatcggggtgtatcggacgagggcgacgatgaggtccccgcaccgctgacggagctggaccgcctggccctgctggcggagacgaccactcagctgacgtccaccttggatgtggacgaggcaatgcgccggctggcggccctgacggtgccccggcttgcggactgggcggtgatcgatctgctcaccgaacgagacgaggttcgacgcgccttggtgacggagcacaaggacggaatcctggtcgggcgggaggacctgcaaggacccatgccccccgtgccggaggagtcccccatgcccctgtcgcgggctctgcgcggcgccgcgtcctctcttgccggccctgccacctatcagggcccgcccgattccggaatcgcggtcgaacagggccgcttgttcagcgagacgggcatgcactccgctgtcatcgcgcccatccgaggtctgcgcgacgtgctcggagccctgaccctgggacgctcgacacgtcctgacgccttcaccgccgccgatctgccgctgctggaggacatcacccgccgggccggcctggcgctggacaacgcgcgtctgtaccagcgccagcgcaaggtcgccgaaaccatgcagcgccacctgctgccccagctccccaccgtgcccggggtgggcatgacggcgcggtacgtacccgctccgcacgcctcctccgtcggcggtgactggtacgacgccttcgccctgaccgacaactcccacgccctggcctcggcgacgttgtcgggcacgacctcgacgccgcagccggcatggcgcagatccgcaacatgctgcgcgccttcacatggtcccagccccaggccacgcccagcgccgtcgtcacccagctcgacgacgccgtgaagcacatagccgaggtccccatggcgaccatgatcctggccacgctcactcttggcgacgacgagctgtggcaactgcgctggacgaacgccggccaccctcctccgctgctggtcagccatgacggtcgtgcccgctacctcaccgacgcccacggcattctgctcggtaccgggacgatccggcctcgccccgacgtcttcaccgtcctgccgccccgcaccaccgtcctgctctacaccgacggcctggtcgagtcaccccaccactccatcgaccacggactggaacggttgcgccgacacgccgcctctcttgcccaccgccctctggattccttctgcgacctgctgctggagcgggtccgccccagcgacaacgacgacgacgtcgccatgctggcgctgcgcacgcccactcgtgcatagcccggaggccacgatcagcccgtagctacgccctgtcacccgttcggacctcttgcgcgtgcccatcaccggggagagtgtgcgagggcacggaggagcagcagaagtggtccttgaggactacgacatcttctacttcgacagctccgatctgccctgggaagcgcaagacgcggtgatcccagctgggcaggagctgttcgacggggtgccggccgaggtggagggcggtccgccccgcgcccggctggaactgggtcgccgcgacgccgtcggcgaggccgaactctccggtgacgccggtttcgcagaacaaggcgtcgtcgtgctgaatcccgcgcggccacagattctcgccgtccccctcgtcgaccacgacgggcccggccgcctcaaggaagtgcgtgaaccaggcgaagggccgctcgtcgcgatcgacatcgccgccgatgaccgcgggcagcgccgaccaggggtagacggcccgggatccgggaacggtgttgccctcttcgtcgacggcaggcccgaaggcgccgatgcggagaccaaggcccatgcaggcggcgcagtagcagtgcggccggacgtagttgctccggtgcccctgcacggaccaccggggccagtgattggtacgtggcagtcatcctgtcttcttctgcgcgcgcaccgtccgggcgcaggcctggcagttcgtcgggatgcgtccgtgggcggcgatcatccgctcgtaagcgtcccggcgggagggcatccagaagtcggcgaggtcggggcgccgtacccggaaccccagttgggctgcttctgctgctgtgatcagggggtgaggtccagaacccggaccggctcccctttccaccggttgggggcggtggtggcgatgatcgcgccgtcgggacgctccggggtgggctgcgccgcgtactgactgtgcgcggcagcccacgtcttttgccgcgcgacggccagggcggcggccaggtccagatcgaggacggtgatgccgggaagggaagccaggtgctcggccgtgccgggccgggcgcggtcggcttcgaccaacgcgcacgccggggcgtacaggaaccagcctgattcagcgtgggcgcggtggatcagacgggaagcaaggacgttgccctggccggctgcggccatcgcggtgtcgtccaggacgatgtgcacagcgtcgctcaccggccggtcgcctgggccaggcgccggtccagcacgctgtccaggtcctgctcctcggcagcggtcggcgcgtagccgttccactccttcaacgcggccagggccttctccgcccgctcggcccgctcggccggagtcagcagcgtctcagcgagacgggcgagatacgcgcgcagcgacaagccctccgcagcagctatagcggccagccgctccttggcttcctcggggatacggacgttggcatcggacatcatcgtgctccttcccatccccgcaagggtacgggtacgtacccgtacccgtcatgtgactgatttaagccacaaccctgttgtctggccgaatccagtgcaatgctgtgacggcggtgatcttccaacccccgtggaggccccacctctaaccccgcccgcgtgctgtcacctgggcgggccgcgccgtccctcccgaccctccccacaggagggccgacacctgccagaacggccctcggcccgccacggaccgactccaacatcgtcgttctggccctgggctggggcgcgttcatcggcgccgggatcatcgccatgtacttcctcggacacgccctctgactgaacgaggaagaccgctgcggccgacaccagcaaggccacagccagcgagggaaccgggcggccagaggcgggcgcctgaaccggcgctcccctcagtccgcaatgcggcgttcgtcgtccaggtgagccatggcgtagtcgcgttcgtcgggatgacgggccaggcgtgccatcacccacgcggtccgggcgtccatcccctcaccgaagtcggcggccaggcgccgcgcctgccacgtcgtgcgcggggcgagcacccactgcacgagcgggaaccggacccggccggtgcctgccccgtcaggggagtgctcggaggggagatcaggggtgttcggggcaggcacgatcgcgagtctggcgacggacccgtcgacgtcggtggtcttcgggccggagatcaccgaaatgggcggcgtcggagcccggcggttgacgcctgctggggcccgcacggtgcgccaagcgagcgacgcagcggcgactgcacgcgcagcggacctgttgaacttgtatgccgtcctcacgcccacgccgccgctcgccgcggccgccagccgtcacccgcccccacgccccgctgaccggcgatcgtccgacggcacaaggatcggcacccacctgcacggcaccccggcaccggagcccgacacctcgcacccgcccctcagcacacccctaccagccccggcccggcctgaccccatatcaggtttcccgtcctgcgccccgcccgccgctcccggcagtgcggggtgcagtctgtctgtccaacgcgacctggaggacctgctcgtgctcatcccccgcccgcgccgccggaccggccggcctcgccccagcgacccggtccccgctgtcggagccgcttgccccgtcgctgtgcgagggcgattacctcacccgtcgaacatgcaaaatctatgttggccggagtagacattgggtggtggcgtggttatggtttctctcgtagccaagagagaccgcagggcctggcagagacgaactgccgggcagcagtacccgtagttgcagttcgcaggacggtgcggtggtggagtttcgaagccaggttgttggaggacggcgacgggactgacgaccggaccgggtggcccgcagtgatcaggggccgccgtgagcagtaccgcagtggcagtacccgcaagtgcagttcgcagtacccagcagtgaagtcagtgagcagcacctcggtgaaggcgtcggctgcggacgcgcgcaccgggaggttcggcagtggggttctaagccagagcagacgcaagacgggcgacggggctggctgccgaagagcggcgctgtcacaggccactgagcagtccccatcaccagtagtacgcagtaccagcagtaccagcagtacgcagtaccccgcataaagagcagttgatcaccgagggaagaacggaggagccagacgccatcaggatcgcccgggccgaaatcttgagcccgggtaccgcaggacatcgatagtgaggtggtctccggtcaagcaaccgcgatccccgcacccccgacagcaactcggtcgggtcagcggaaacagaaagccggcgcagtaccagggccggcagatggtgtagcagttccttcggggccctggtgccagtacggcaccagggcccctccacgcgttccacagagaggtgcaatgacagcagacgactcgcacaaccgactcgaggacgacgactaccccgcctacaccatgggccgggccgccgaactgctcggcaccacccagggcttcctccgcgccatcggcgacgcccgcctcatcaccccgctccgctccccaggcggccaccgccgctactcccgctaccagctgcgcatcgccgcccgcgcccgcgaactcgtcggccacgggacccccatcgaggccgcctgccgcatcatcatcctcgaagaccagctcgaagaagcccagcgcaccaacgccgaataccgccgcaccgccgaatgagcgcacccaacggccgcagctcaagcctgcaactcccccaggaacttcacgaatgccacccacacatgctgcccgggacgcaaagcgttccgggcagcttcgtcctctacggccctggagccggcagtgatctacgcacggagagtcactcgtggaggcgcggtgacgtcagctggaggaacccggtgctgcggcatcgacaccgaggacgtcctcctggaggccctcgccgagccgcggccgctctccgcacatcgactgcctgctcgactgcaccagggtgaagaccgtccgcgcatcggcggccgcatcggcgcctgacggtagcgggccccgggacggccgcagcatcggctaatgcgcgtcggccgccccgggcactcccattctccgtcaccggcgcgtggccacccggcccgcggttcctcgcgacccgcacgacgtcctggcggaactcttccggataaggcttgggcacagcgacatccttcccacccgcctcacagggcaagccagttcagatgtcacccgatcgtgcagcagacccgcggcgggggcagtgacccgtcccggtcggtcaggaacctcaggctgccgcggcgacaccgatgccgatggcgatgaacagccagccggtcgtcagttcccagccgtggcggaccttcgggcgggcgaggaacgcccgtagccgcgcggcgacggcgaccagggcgaaccagtaggcgacgccgatgacgatgtccagggtgccgaggaagaagatctgccgcgaggtcgagccgccgccgtggacgaactgcggcaggatgctgaggaagaacagcgccgccttgggattgagcacgttggtgaggaaaccctgggtgaagccggaccgccaacggccgtgggccggcgcctcctcctccggagttcgcgggtcagtgccgtcctccacgccgccgaccgcctcccgcccagcggcccgctcacgggcggcccgccgcgcggccagcactgcccggacgcccaggtagacgagataggccgcgcccagcagcctgatggcgtcgtagaccgccggggagcgggcagcgatcagggacagtccgaccgcggcggcgagcatgtgcacgcacagtccgctctgggcgcccagcgccgcggcccggcccttggcgggatgctcggtggccgacctcaccaccacgaggaagtccgggccggggaccacatacgccaccagtactacgccgaggaagccgacgaggtcgaccgacatccgttctccctttcgccagccccgcggccgttcttcgccggccccgtggccggttcgccgcgcgagggtcgtgcaccaagaggtgcggtgcccagctccgctcaggccgcgagggcccgcctgccgaccgtcgaggccacggactcgtcgagtaccccaaggcccagttccagttgctcgtccgccacggtcaccggcggcaggaccgtggccacctcgtcgttggacccggccgtctccagcagcaggcctccccggtacgccgcatcgcacacctcgcgggcccgcgcccgcacggccgaagagcagccccctccagcgcccgggccccggtgaggaacgccgggttgtacccgcggaaggcgccgttgtgctcgccgggcttccacacgtcgtactcgggacgcagcagcgtgagggccatgggcatcccgtacccgctgatggacttggacaggcagacgatgtcggggacgattccggccggctcgaaggagaagaacaccggaccccgtggtccgttctccacaccgaccacacccaccaccccctacccggcccgacagcccccgtctcatgcgaccctgccggggaagatcacccgcgcagcagtcaggcgcgcgtggaacgagatcgtcgcagccctcgccgatgaggacttcaccgtgggcgatgagccgttgccgacaggactggacaagtcggtggcgtcgctcttgccggagccgatctacatcccggctgtgaaggagctcaatgacgaggtcaaaaccagctcaacggcgacgttcggggaacggcgccctgacgggaatgagttacggcatgattactcgctgtgagacatggcggacgcgggcggggccccaagcgcgtgggcatgcgctacttgtcattgctggtatttggagcgggcggagcgttagtgctggcgcagagctccggccagagcgtggccgcagtggggatgggactactgacagcgctgggaggcttctatctggcctggaaggccttccagcaggaccgcgaccaagtcaccgccatgagcctggggacggctgtcgaccagttggcggaagcggtgaagaaacagtgggacgctgaggcgtcggtccgccgtttgaacgacccatacccactgccggtcgcctggcgggccgctgatgcagacctggtacagccctggacgttgctggccgacgtagcgcggggctggcccggtggtccccccggtgatcccgcccaatggcctacggatgccgccgggctggcgggcgctgatgcgcagatcggtgaggtgtttgcccagcgggtacccacccgccgcctggtcgtcctcggcgatcccggctccggcaaatccatgctgctcatccgcctgctccacgacctgatcgcacagcgacccgacgatggcccggtgccggtgctgttctccctggcctcctggaaccctacccaccgacccttgcagagctggctggccgaccagctaagacacacctaccccggtctacgtgcccccgccccttcggccgcgccccaggcgggccagatcgacttggcccaggcgctgctggatacccggcggatcctgccgctcgtcgacggcttcgacgagctccctcctgcccttcacgcgatagccctcgacgccctcaaccaggccctgcccgcgaaacaacccctggtgctggccagccgcgccgccgcctaccgggaggcactggcccggtccgaagtcctggtgcgaccgctcaacggcgccgccgggatccatctgctgcccctgcccgccgaccaggccgcaacctacctgcgccatgacgcaggcggcgagcacacccccgccgccgaccgctggaacagcgtggccgcccacctgggcacgaacaccctcgtcgggcaggccctgagcacccccctgggcctcttcttggcccgcaccatctacaacccacgccccgatatcctgggcgcacccgcccccgtccctcacccggacgagctgtacgacaccaccatcttccccacccgcgccgccctcgatacccacctgttcaacgcctacatccccgccgcctacacccgccaccaaccgaaccccctccggtggtctccatcccaggcctaccgcaccctggtcttcctcgcccgacacctggagaccaaccgtaacggcagcccggaccttgcctggtgggaacttcaccacgccaaccccgcgtacatccgccgcctgacagctgggctcatggtcgggctcgggcctgggctcctgctcgggctcgtgtacggggtcggcctcgggctcgcggccgggatcgggctcgcggccggtctcacgtacggacttataggtggtgggcttgggtccgccccctcaaacattccaagtacacggctacgttggtcgcgccgcaggttcgcgggctggctcggggccgggcttgccctcggactcgtgggcggactcgcgttcgggctcgggatcgcgggcgaacgcggagcctggctcgcgaccgggatcttgcccggcgagcacggattcgtgggctggctcgcgttcgggctcgcgctcggactcattgccggactcgcgtgcggactcacgttcggactcacaggcgagaagcctgccctaaccaccatgatcggccctgcgacactactcatccaggatctccgcaccttcctcggaggcgggctcgcgtacgggctcggggccggattcgtgggcggattcataggttggttggtgagctggcttgcattcggggctgaggacggactcgcgttcgggcaggcgttcgggctcgcgttcgggctcggggcctcccttgaacagacagcatggggcgactgggtgatagccaaggcttatttggcaatgtggcgccgagcgccttgggatttgatgacgttcctccaggatgcgcatcagcatcgtggtgtcctgcggcaggttggggcggtgtaccagttccgccacctggacctgcaacgccacctcgcccagcaaccccggtccctccccacctacgccgggcagcccgattcgccatctcggctcactggcgaacaagcgcggtcaattcatcgccgcggaaacacccgaacaggaagcctgttcgactgaccaagcctctcgagcggtaagcagatggctgctcagagctccccttctccggcggtgctgggggcggcaagcaaggtggcatagacgtctgtacggacctcgcgctgagtggcgcgggcctagacggtgaaggcctggccagcgacattgaactgggggcgagaacctgccggcgcggtgatccactgcgaatagcccacgacgtaaccagcattggcggtcgcgaggcggcagaagccgaacgagggtgggcggcagggcggaaaccacacgtcgcgcgcgccgatctcgcccggctctcatggaccgcccgcgaggccggggccgcgcgccggtccgacaggcggtaaatgggccctcctcggcaggccccgccgtcccggacagaccgcgcaggaggctcgctgccgtgctcccgcgtaccccgggtacccgacggatgcggaagccgacctcgtcctggcggtggcgcggtcgtgctcaccgtgcccttgggctgcgcccgttactcggcggcccaccaactcgtgggcctgagcgaagcaaggttcacatgcggctccccgagaccgcgctgatcacggtcggcgcactcgtctcgggcacgagagccctgttctgtggggcgtgttgtgggtgggtgatcgccgaggacctggagaagatcagcagtctcgccacccccgcgggccattacggtgccgaccctgacgaagatcccgtgcgtgaggcactggctgtgccgactggccagatgcgtgctcagttgggtgcgatgccccgtccgctgcccaagacctcgaagccgccgtccgtcagattccggcggcctgcacttgggcgaaggtgccgaccttcgccgaccatgcctgctgatccggtacagcacgccagccgatcagcgagtcaggggtgacagtgtcaggccagatcacgtagccgagcatgatgagttcgcaccccgccgcatgcgcggcgtcgaccgggaatgtcggccagtcgggccagtgtgagaggtgcttctcggcgaggggctcgaagccgtcatcccggaccacttgcagaagatagccgctgtccgcggccttgcagatggcagtgagatcacggcggcagttctcagttgccatgccaggacgctaaaggaaacgccgtactggcggagcgtcgggtaccggcgtggaggctggtcagcgcccgcggcgatcagaccccatccgccgagtgcggcgctcggccgctactgacttcggcgttctagggtctgtcgagagcgaggcccgtcccaggcaaggaatccgccggggatgccggccggtactgcagtgccttgagccatctacggagcagagtctccaactcgccgagggtgcggggccgccaggttggcaaacctccgcatgatatgcgcccataggccctgggagtcgatggctggcgcagtcaggagcggacgcgcgcgctgttggtcgtggcagcagtgaagcgcaatgccggtaaagacccctgggccaagccgcccggaggtcaggaattcctctgcacgattgaggagttgctgatcgtgcctctgccggttgctttggcgatggcctcggcgttgtcgatgttgacttccaggttcgacacttcggctgcactgccggtggcttcgatgcgcactgcggcgtcggcgccgtgggcgacccggatgcggtcgaggtggccgcgacgccgggctgtgagccgggcagtcggcggtgaatccgaccgaccgtgtgcggcggaagccgcggctgctgcggcaccggcgatgacgaggaccacggccgcagcgatcagggccgggctccaccgggtggtgaccaggttggtcaccaccgcggtggcggcggacagcaccgctccgaccgccgccgtgaccttcggacctggcatgtacatggccaccccctgtgatggtccgacgcggcaatacaccaacgtgtccgtcgccgcaaaggcacatccgacatctcagttaccgccctaccatcacgaccgatggccagcgtggagtcccaccttgccagagactgtcaccgctggggggccaaccaccgtgtctcaggtattcaccgatcgccgggaggcactggccgcggtcgagcggctgacgggcgagagctcgccgctccgggtgctcgtagtgcagggtgtgtccgggaccggcaaatccacgctgctgcgctacgtgctgcaccacggccggcgtggccttcgtacggtccggctggacgtgctcgatgtggtcctggccccgttgccggtggaaaccgacgtggtgctgcgcctggtgaggtccctggccatccagctgtccacggccgggccctggtggcgccgacgccgcctgcgccggcaggccgagcttatcggggcggagcaccccgcaaccatcaccatgatcgcccgagggcacgggcagatcaccggtgtctcggcggtcgccgacggggccgcgcctaccgcgcaacgccgggaggcgtgggtgcaggcgatgctgagcatcgccgcacgggtgcgccgcccggttttgctggtggtggatacaacggagttgctgtatgtgttcgacgatgccgcccgagaagaccgggctcgcacggcgatcggcgtcggagactggttcgtgcgggacatgctggtccggctgctggacgtgtctgcccggctgcgggtgatccttgcggggcaggaccagctgacgatgacgggcctgcccgattcggcctggcaggagctggaactttcaccctggagtcaggacgacgtcgtcgaccactttgccgccttgggcctgggcctggagccggcgcgacaggcctacatgatgtccggcggaatgccactgatcgcagccgccatcgctgacctttgccagagcggaatcggcggtgagggcgcgtggctggatcaggcggcggggcagccgacgtcgacctggctggtggacaacattctgggtcggctctcggccgagcagcgcatgctggtacaggccgcctgcgtgttacgagtcatcaccgagcccgcgctggcccgcctggtggccgacaccccgctaagcgccggctggttcactgccctggctcgccaccaactcttacagaccgcgccagccacaaaccgggcaccccgtctggtgatgcacgccaccattcggggatggctgctggagcacctggcccgcgccgaccgcgaccggatccccgaccgccggcagctcccgcgctggcaccgggccgctgccgagttctacgccgccttggccgaggggagactctctgccgaggagatgtaccaccgcttcgccgccggagacgccgctcccaccagatgccggctatgggaacaggccgtcctggcagccgtcaccgacggccgtctcggtgatgcgttcacactggcccagaccgcgactgtcgcggccgccgaaccggcccagccgaccgtgccccaccccgcgttggcactggccttccatgcccaggcccacatcgcgctcttgcaaggccacctgcaccaggccgaccgtctggccgccgacgccgaccggcactaccagcaagtgcccgacactttcgggcaggcacaagtggcctggatgcggggcgagctggcctggcgcgaggaccgctacgacgacgccgcggctttctggcgccgctcacttcacacccctggaggcatcaccgaaccggccgaccgcgccgacctggctctcgcattagcccgtgccgtctgctgcatcggtgacctgcccgccctcgacaccgccgtcgacactgcacgccatctggccgccgacgccaccgcaccggctccacatccgaccgatacgaccgctcaccggctcccgatgatcccgctcacccccaccactacggcccagatccgccccgtcaccctgctgcgtctccaagccaccggcgccttcctcaccagcaactatgcccgcgccgatgccctcatcacgcagggtgtccgcctggccggcacactcggcgaacccggcaggcacgaacaagccctgctccacgccgtgtacgcgagtgccgcgctgctgcgcgacgacctcgacgccgccgaagaggcgctgaagcagggtctacaggctgcccggaactgtcccaacgctcgatgccgtatcaacctcctgcttcggcaggcgcgcctggcccgaatcagagcccaatccggccccggtctgcccacacacccgaaccccgcaccagcagcggtccagatctcgctgaaggccgccaccgaagcggcccaccagcgcgccctcagcgagcggtacgtccaagccgccctcgacctggccctcgacctcaccgaccgagccagccaagccgacgcactggacaacctgggatatgtcgctcttgaccgcggggacctcaacaccgcccatcagcaccatgagcaggccctgaccctctaccagcacaccggaaaccgcctcggccaagccctcgcactgaacaacctgggaaatgtggcccgtgagcgcggggacctggacactgccgaacagcaccacaaccaagccctgaccttgtaccggcaggccggcagccgattcggccaggccagcgcactagacaggctggggatggttgccaaggagagcggggacctggacaacgccgagcagcaccacaaccaagccctgaacctctaccagcagatcggccaccgctccggccaggtcgccgcactcggcaatctggggaacgtcgcccgggaccgcggaaagccggagagcgccaagcagtactacgagcaggcaatggcctccttccagcagatcggcgaccgctccggccaggccaccgcgctggaccatctggggaagctggcccgggaccgtggggacctggacaccgccgagcagcaccacaaccaggccctggccctgtttcaacagatcggccaccgctccggccaggccaccgcgctggacaacctgggacatgtagctgaagaccgcggggacctgaacaccgccatgcagcatttcgagcaatccctggccctcgaacggcagaccggcgaccgcctcggccaggcacacgcactggacaacctagggcacctggcctggtgccgtagggacctggacaccgccgagcagcaccacaaccaagccctggccctctaccggcagaccggcagccgacccggccaagccacggcgctaatgggtctggggagcgttgcccgcggtcgccgggacctggtcaccgccaagcagcgctacgagcaggcattgaccctctaccaacagaccagcaatgcctccggccaggccgctgcgctgaacaacctggggatggtcgctcaggaccgcgcggacctgaacaccgccaagcagctctacgagcaggccctcgccctgtaccggcagaccggccactaccccggcgagcagcaggtcctgcgcttcatcaaccagctcgacggtctcgccccgccttcgggcccatgacggcgcctgtacgagttaggtgtggacctgccccagatgcagtggcaggcacgggagttgagctggttggtcaccagggtggtggcgtgttcgatgtcgtcgcggttggcgaatgaccggccgacgaggacggctttggggaagatgcgctaccagccgatcggcttcaccccgccaatcctgcctccgctagcaacggccgcttggtcatgaacgtgctgcctacgtctatagagccgcggttgctcctttgcaaaacagcggctgagcacacgcggcgggaatctgctcgcgtgcggtgtactggacagcagcaggttccccagtgccggcttagacattgtgccgacagaccgctacgcagacggtggccagccacggccatgctgccgtcacctggatgagggtgccgttcgggccgcccaccgtcctgactgccagctcggctcccgcgatccggaagcagcggacgtcggtgacgtcaacgcggccccggcatgcccttcggccccgaaatcgccatcgacgcaagcgcaccacctctggaccggctggtcgctttcaccggccgcgaccccgcttgggcgccccccgtcagctgcgctgatgagcgcctgcggcgtcgtcctcgcttgacggaccggcggggcgggcggcagctgccgcccgccccgccggagccgcccgccctggatcatccgcacgccgagaacggccgggggcgctgcctcgtcagcaggctcgcggcccgctgagcggtgtcgccccagccggactccgcgcagggcaggacgctgtgggccggggtcaaccccgtgagactgcgggttcgggctcggcagcggactcgggcgcgctttcgctgaggccgaaccggccgtggaatctgcgcaggaagccgggcgcgtaccaggccgagtcgccgagcaggcgcatcgcggcgggaacgagcacaccacggatggcgacagcgtcgatcaggatcgccagtccgctgccgagaccgaacatctgcatgaaactgagcttggccgtaccgaaggcgaagaagctcaccgcgagcaggcaggcggcggcggtgacgatgcgcccggtgtgcccgaggccgttggtgacggcggactcggtgtcctcgcccggggcgtggagttccttgatccggctggtgacgaacacctcgtagtccatcgagagaccgaagacgatgcagaacatcagcacggtcatcgacatctccatcggctgcgccgtgaagccgagcagggaggagagatggccgtcctggaagatccgggtcatgatgccgagcgtcgccaccagggtgatcgcgttcagggccagggcgcgcagcggctgcaccacgctgccggtgaagaggaagagcaggacgaaggtggtcacaaccaccaggccgatggcgagcgggatctggccgctgatggagtgcttggcgtcgaccagttcggcgtcgatgccgcccaccagcgggtgggtgccggggggcggggtgagcgcccgtacgtcgccgaccaggctctgcgccgcgtcggacttcggcgtcaaggagctgacgacgctcgaccctgttcctggacgactggaccgtcttcctgcgcaccgcccacggcctccggacgcaccgcggcacgaccctggccccggcgaagggtcccaccgccatcagcgcccgcaacgtcacctacacctaccccggtaccgccgtacccgcgctggccggggtcgatctcgaactcaagaggggcgaagtcgttgccctggtcggcgagaacggctccggaaagaccaccctggcccacctcctgaccggcctgtacctgcccgaccacggcaccgtggaatgggaccaggtcgacctcgccaccgccgacccccagagtgtgtggaagtccgtcgccatggtcccgcaggactacacccggtggccgctgacctgccgcgagaacatcaccctcggcatgcccagcgacgaaggtgacgccgccgtactccgagcagccgaggaagcgggggcgatggccgtcgtcgcgcaccttcccgacggcctggacacctcgctagcccgctcctggtggggcggccacgacctctccggaggacagtggcaacgcatcgccctcgccagggccttccacaaggacgcccccgtactgatcctcgacgagccgacctcggctctggacgcccgcattgagcaccaagtgttctcccggctgcgggagttgtctgcgggccgcaccgcgctgttcatcacacaccgtcttgccaacgcccgcgtcgccgacaaagtcatcgtcctggagaagggcgcggtcgcggagagcggtacgtacgacgaactcctccggatcgacgggctcttcgccgaactccaccggatgcaggaaggggcggagagggacatcccgacgccgcgcacgacacggatctgatccttccgcgcgacgccgggcaaggtccagcccgagtcggcggcctacctgatggacggaggcgtcgccgtgctgctctcgacaacagcgcctacaccccatcggacgtagcgcgccgaatcgccgacgccatcccggctctgccgctagcgtcggtcccctcccccgccccttcgacccccaaggaacatgagcggacaaccggcaacacccgtcatcgacatccacgtcatcctccgcgacggtgacaagatcctcttctcccagcgcggcggcccgtaacggctacggccggtggcacatgccttccggcaagctcgaccagggcgatcccctgcccgccggtgctgcccgcgaactgttcgaagagaccggaatcaccgtcgccccgggccacctccggctcgtccacgtcgtgcaccatcgccaagacgacgaggtggaacggatcggcttcttcttcgaagccacggactggcagggagaacccgtcaaccgggagccggacaagtgcctcgccttgacctggttcaccgtgcacgaactgcccgacggcatcatcgagtacccgcaggccggactgcgcggatatctcgacgagaccggtcccctcgtcgcacacaactgggagtaggagactcaccttcagcctgacgtgatgtccagtggttcccgcgtaggcggggggccgctgcctgcacccgagccgaggcggtcgccccgggcagccagccgccgtatcgcctcgatctcgcgcgcggccaccgggggccctcccggattcgggagggcctccatccggtgccgtctcaacccgccagtggaccagcggcactcgacggggcgtccctgttcggcaccgccctggtcgtctcagatcagccgcaaaaaaatcttggttgtcgtgtcaagaatctgagaagctgttgctttatcgatcttggtgggcgtgagttcgaggtcgtcgactcggtcgggtgatctcgtggctggccgggcatgaaagcggggcctcccgcacagctcgtgggtgtcgaatccaaccgagcaacaggaggcccctggtgctgcagtcttccgtgccagcgtcgatgtcgtccaactcggcgtctctgtcgtgtgattgtctcgctcaccggttcgggaacgctggggaccggccgtacaggcgaccgaagtatccgtcggacatgagcgacgcggagtgggccgtcgtacgtgacgcgatgccggttcccggctggctcgagggccgcggcgggcaaccggagagctattgccaccggcagatggtcgacgcggtgcgctatctggtcgcgggcggcatcacctggcgggcgatgccggcggacttccccgcgtgggaccgcgtttatgccttcttccggcgctggcgggacaagggcctgaccgccgagttccacgaccggctgcgtgaccgggtccgccaggccgcgggccgggatctggagccgacggcgggcatcatcgacgcgcagtcggtgaaggcagccgcatcggtgccggccgtgaccaggggattcgacggcgggaagaaggtcaacggccgtaaacggcacatcgtggtggacaccctcggactgctgctggccgttatggtgaccgcggcctcggtcaccgaccgggacgcgggacagacactcctggcccggctgcgcgaacggcactggcgcgtcacgcgggtgtgggccgacggaggctacaccgggcgcctggtcgacttcgcccgcgacgcctggcggatcgcgctgaccgtggtcagacgcagcgacgacaccagcggtttcaccgtgctgccgaagaggtggctggtggagcgcacgttcgcgtggctgatgcactcacgccggctggcccgcgactacgagacgcgcaccgacacctcggaggcagtgatcaagtgggcgatgagcacagtcatgaggcgcagcaggcgctcgcgcagcgttctcctcctggccggcggcgcgttcgcgcccggcgagccaacttccgacggctgtatccagcgcgtcgccgtcgatgcgttggaggacacgacgcacggtggcctcggccggggcgacggggccgcggtccggctcccggcatgggccaccgagccgggccaggacgttgggcggggcgtcggcggcccactccgcgatcgcggccagggacttcgctccggccaggaccgcgcacgcggccagggagaggacgaaggcgaatgggttgaaccgggatccttactgtgcgccaacgtacagcgaacatcccctgcgtaccctggcattttcgccgcccaagcggagccgacctcccctcttcgcgcgggcctgtgtcggccgtggggaaccctgtgacaagatccgctggcatgtcatctgtcatgtcgtccgccatgccttcgttgccttcgtcgcccacgggtccctcaagaaccggtcgccgtctgctggtcgccctgctcgcgatgctcgcgacagcaggctccaccgtggccgaggccggcacgccgtccggcccggcgcccggcgccgcggtgagagcggccgaacccgcgacgcctgaccgccccagctacgacgtgaagctgcgcgccgatggcgacggctcccactgggcgggccggcagacggtgtccttccgcaacgcctccagccggcccctgcgtgaggtgtacatacgcctgtggggcaatggcgaggacggctgcgggacatccggaagaccgtcccccgtccgcgtctcccacgtgcgcggcggcactccgggccgccccggcgtgaagtgcacggcgctgcgcatcgctctgccgaggccgctcgcacgcggtgagcggacggccgtctccttcgacgtggccctcaccgtgcccgcacgcaacaaccgcttcggccgcgaaggcgcgttccgcttcctgggcaacgcgctgccggtcctcgccgtgcacgacgcgagggggtggcacctcgatccgtatgtgtcgtacggcgagagcttctacaccctggcgagcgacttccgggtgcgcctcgaccacccgtccgccctcaaggtcccggcgaccggcagcacatggacccgccccggcggtaccgggcgtacggtcacccacagcgtcgccaagcgggtgcgggacttcgcatgggcggcgggcccgttccgcaccgcgacccagacctcgcccgacggcgtgcgcgtgaagtcgtattggtcgccgaacacgcccgccgctggtgtccgcctcaaccgcaaggacggcgtcgccgccatcgaccggttcggcagggagttcggccgctatccgtacggcgagatagacctcgtgatgacccccgggttcgccggcggcatggagtaccccggcctggtcatccttggcaccgaggaggagggcggcgccaccgtccatgagatcgcccaccagtggtggtacggcgtcgtgggcaacgacgagtacaactcaccctggctggacgagagtttcgctcagtacgccaacgcgcgctactaccgctgggacgggttcgagtgctcgccggacgactcctggccgagcgccaccgccgcgctcaccaactcgatggcctactggtctacacaccgtggcgagtacttccaggtcgtgtacgggatcggcccctgcgtcctggccgacctggagcacgtcctcggggccggcaccatggcgcgcctcatcaagaagtacgcccacgaccactggtacggcgtctccaccaccgtcgacttcaagaaggccgcacagtcgatgacgcacagggacctcggccccttctggcggaagcaccgcatccgctgaagtcgcactccgctcgcgggtgacgggcgtaccccggcggcgccacgatgacggtgaccgacggggtaggcgggcagggcggcgtcgttccggcggtgcatccgggttgatggggcttcaggagctggggcaggactgcggagtggtcggcgggggctgacgcggaggcaggcacgacttccggtgatcatgaggtgtcgagtccctgatcaccacgacggaagaccgtgcctgcccgctcatcctcgctcatcgcgcgctctctgggccaactcgccggcaccgcgccgaccgtccccgatgacctccccggcctgctgacctgcctggctcaggtgcccgatccccgccgggaccagggccgacgccacccgctcgccttcgtcctctccctggccgcgtgcgcggtcctggccggagcgaagtccctggccgcgatcgcggagtgggccgccgacgccccgcccaacgtcctggcccggctcggtggcccatgccgggagccggaccgcggccccgtcgccccggccgaggccaccgtgcgtcgtgtcctccaacgcatcgacggcgacgcgctggatacagccgtcggaagttggctcgccgggcgcgaacgcgccgccggccaggaggagaacgacagcgaccggcggcccctgccctccctcgccgtggacggcaagaccgtgcgcggtgcccgccgcaccgacggcacccaggtccatctgctagccgcgatgacggggaccggcctggtcaccgcccagcgcgaggtggacgccacgaccaacgagatcaccgtcttccagcccctgcttgccccgctcaacctgcacggcacggtggtcaccttcgatgccctccactcgcagaccgcccacgcgcgcttcctcgtcgaggacaagcacgcccactacatcgcgctgatcaagggcaatcagcccaccctgcaccagtggctgaaggccctgccatggcgggaagtgccactcctggacaagacgcgggccaccgcgcacggccgcgacgagatccgccggatcaaggccgccgccgtcgccgggatcgcgttcccacacgcggtgcaggccgtccagatcgagcgccgccgacggatcgtcaccaccggcaaggtcacccttgaacgcatctacggggtgaccgacctgaccgcggagcaggccgacgcaaccgagatcgcccgccgcgtccgcggccactggggcatcgagaacaagatccaccacgtcagggacaccacgtacgccgaggacgcctcccgcgtacgcaccggcaccgctccacgtgcaatggcatccctgcgcaacctggccatcggcgctctccgactcgccaaccagacgaacatcgccgctggactccggcaccacacccgcgacgccaaccgtccactgatcaccctcggcatcatgtgatcaaccaggacacatcacctgaacgacgcggccctgggcatcgaccgcatcgagatccatcacgatgccgccaaccctgccagcggggccgtcgcccgccgcttgggattcgctgaggttgagcgcatacgagcaactgacgggcacgtcgctcctggcgaagtgggaatcgatgtcatttggcgtatgacggcagaccaatggaaggcaaggacagccgagcacgctcaacaagcgagctgagtagaggtaaatgccatagagatcggcgtacagacgcaggttctcctgggcagtcaggtcatcgtcggtagtggattcctggaagacgacaccgatttggcggcgcacgtcgtgaggggagcgggtgatgtcggcgccagcgacctgggcgtggccggtggtggggcgcagggtggtgcacagcatcccgatggtggtcgacttgccggcgccattggggccgaggaaggcaaagagttcgccctgggcgacggtgaggtccaggccttggacggcttcgacatctccgtaggtgcggcgcaggccccgggtaacgattgtcccagggggtgaagtggggtcggccggggtcatcggcgggccgggacggacatcaccaggtggaagtcggtgacggcgtcagggtcctcgccgaccgcgtcaccgtccacggcgacccaggcgtgcgcggcgaagggtcgagtggtcacgccagtgcaccattgtggccaggtgccgcccaggcggcacagtagcgcagtggcgatggaacgctccaggcagcgaggcccggcgatggtgacgctgacggacaccacggcgttgcgggcttgcagcgcctggggcagatcggccggacgagcgccccggctcgcgagttcgaggacctgacgcaggcgtcgcggcgatacgcgcgccagcagtcgggcggcggtcacggtgactagggcggcggggcgctggttccacggaatggcggtggacggttcgagagtcagctggccgctcatgacgcggccaccttggcggtgcgcagggcgtgcagcaggttgtcgacgtcctgctcgacctgggcggttccggcgtcggggaaacgttgacacaggctggcaacgacgccttggggggacgtaccgtcaagcagggcgcgcagggccagggcgcccgtgccgttgagcagccagtagcggccggtgcgttcgtcgagcaagaccgtaccgtgctcggtgtcggtgacagacacttcaggtgccagggcaaagttcatcatatttccttgacggttcgaggggagggaacgggcacggcggtggcccgggcggtgtcagccggggacagggtgcgcagccacaattcgcaggcgagggtggagtccaggggcatcaggggccgggtgtcggcgtgcaggccgcgcaggacggtgcgcaggacgtcggcgtcgacgaagcccatgcggaccagatgggagtcgtccatgagcttgaggagctcgccgcgccgacggcgcagtcccgcgtagagctcggcgctggcgtcgcccttggtcgtgcggctgagcaggccggcggggacgatgctgcgcagggccgtgccgagcatgggcttgaactggcccagggccacccggtcctccagccgtaccgccagaatggcctccaggacccggtcgtcggtgaagggtgcgtggaaagtgacgccggtatgggcgccgatatgggagttgcggcgggtggcattgccgttgatgcgggtgagccggatcatctcgtgctggacgggcagggtggccagcggctgaggtgtggctgcgagggcggcgaggagttgacgccggacggtcgccgcggcgtgcggggtggcccagggcgggagtttcggcagtggctcccagtctgctccggctccccaatcgtgcctgtcggcagggaagttgctgcaggcggccagccactgcgtgtatgagggtgcagaggcgagggtacgggcggttgtagtcaggggccagcggcgcatggagcgcagggcgcgcaagtgtggcagggcggcgagaggatgccgtcggacgagggcgtgcagagccatcgggctagggtggaagagctcgtcaccgccaatgccttggaggtgacgtcgcgagccgtgcgctgcggcaagccgggccaagtgctcggtggtcgcgcgggaccgtacgaacgtcagggggccttctcggtcatggacggcgtgggcgagaggcgcgtaccagtccggggcttgaccggggccgaccagaaggtgccgggcgcccggcaaagcggcctcggcctggcgggcccagtaccgatcgtcgctggaccggcccagcgcctggtagtggaccgtcaccaggtgggcgtcgtggcggtcggcgtcggccaggaagcacaggctggtggagtccaggccgccggacaggtcggcactcacgacctcctggcccgcggtacaggtcgccaccgcctcggccagcgcctgtcggatcatgtcgccgttgcccagggggcggtccggatccggcgcagtccaccattggcgggtacgccccgtgccgtccctgccgatctcaaggcagtgcccggtcgggggtgagcacacgccacgccacaggctccgctcgctcagaggccacggcggcccgaagggcgagagcagtgccagtgccacctgatcctcgtcgatgtcggccccgatccggtcggccagtgcctgggggcggtcggcggccagggtcactccggcgaccgtggcgtagtagatctgacacgccgctgagagcgtgccctggacgcgcacctctccgtttaccgacgccacgaggtggaagcttccagcggctgttgcggctaggccgtcgaggtcgcggaccgaccggacgtcgcgcagccgccgggtgaggacgtctgcgtccgcggtggtgcggccgagcagagccacgcgatgcgggcccacagcggtgaccatgacgtcctcttcgttccagcagcccacaatccacggtcgccccgagtggtgctcaatcacgtgcgtcggtggcggtccggcagttggcatgagcgccagggccgcagcgccggccgggtggtcgggaagtaccaagaattccatgccggtcccttccacaagggtgagtaagaggtggggaagacgcacggctggcacggatcgtctccgtgccagccgccgctcaggagtgtttagagcaggtgctcagctccgccgaaggcggatcagaaccaccagccgccgaggaaatccacccagaagccgcggtaggtggcgcgggtgacgtcggcgaagtcaccgatctcagtgagtatgggcgtctcgtacgaggtctctgcggtcatggaaggtcaactccttgagttggatactgcgaacagttgggtgttccccgagccagcacgacagtgctggctgggtgtggggggatcttgattcgcgtggcccgatgcaccgctccgggcaagcgccatggagcagccggtgaggagactcactcggtcggccgggcacaacagagcctgcgggaggggaccggacagagcaacagcagagccatgtcccggacagctccgctgctgtcctacctggtcagatccttgtccgggttcttgtcccggtccggaggcgagacaagactgggcgctgacgccttgtcggtgagcttgcactggttgtccacggcacccagtagtggcctatctcagcgccgtactgacccgatgccacatcagtgatcacgtgacttaaggtgagcgccgtcacagggcaacagagatggggagggcggggccggtggcgttcttgaccgacgaacagcgccgtaactacggcacgttcaaccaggtgcccgacgacgggcagctcgccggctacttcctgctggaccgcgacgcccggcggcgggcgatgacctgccggggcgcgaggtcacagctcggctacgccgtccagctcggcaccgtgcggttcctgggcaccttcctggacaaccccgaggacgcgcccgccgaagtcgtcgcctacgtcgccgagcaactcggccacccgggatcggtgctcgccgggtacggcgccgagcgcacccgctgggaccaccagatcgccatcaaggacgcctacggctatcgggatctgaagggcgacgcctggtggaagctccgggacggtgactgacctccactccttcgggtgaggcgccctggcggtgctggggcagggtcagtacgttcccctggacttgatgatcgagggggagagccaacggatgagcgagcgcgacgcgttacgggggctgcgggccttgatgtgggtggtgatcgccatcgaggtcccggtgtacctggtgtggctggtcgaggtcagctacctgaccgggcagcagctgccccgcggcaccgaagaagaagacgggaagccccgggccgacaccgactgatgccgacgggcaacaggcccgtacgggttgtgcgtcaggtacgcaacgagtcggacgccgggctggtgcacgatcagcctgcggggatggacaagttgatcgagttggccagcacgctcgtatcgggggcgttcatcgaccaaccgctcccgcaaccgccaggagcagcaggccgagatcggtgcgctgcgggtgcaggccgacgcgatggcggtggcagtgatggaactgcagggcgcggccgccgccaaccgtctgctgtgggaggggccggccgagcggggccggacgttcctgctgacgctgctcgccttcgcgggtggcgccgcccgggcccgcatcgccggcggcacggatgtgcagagcgggctggtgggcttcgggcaggcggctgagttgctgagccgggaacgggtggccagcaagcagaccgtggccgccgtgcgggagccgctcgctcaagccgccaccgccgccgccccgctcatgcgctgctccgccccggccgtcgtcgctgccaccgagcagctgctgaacgccctggcagacgtggagaacaccgcgcgcctggaggctgccctggaggccttcggccgggccgtcaacgtggccaccccaccgcggctgtcctggtgggcgcggcggcgcgccgtctcgtcaggatgatggccggcccctggctgcccatgctgaggctgcgggcccgcagcctagtcagcggcgggtctcccaccacaggatcagcagcgtcacggcgccgctgcccagcttgtaggccatgccctgaaggaagtggtgatggacactgtgtccaccgcttccgcgccatttccgcaggcgaatgtgaatggacgacagccatctgtccacggggcgtggatgcttgtctcgtgaattcacgctaggctccgtactggtgttagttgctctcggcgacgcctgaattctggctcagtcaagatttccgtgaagccgatcagtgagccgtctggttcgtaactctgtgttgtcggcggtcggcggcgacgagaaggacgcgcttgcggagcagggggagtccggctcggcctgccatctgccgcttgagcagcttgatgtccgtgactctgccctcgacgcagcccgagctccattccgtgctcagtccgaggatgacggcgtcgaggtcggccagcaggccatcggcgaagccgcgcaggccgtggtgctcgtcggcgcgggcggtggcgatccattcgggcagtcggctcgcgctgcggatggccatcatcgcggcgaaggaccggacatgtccggtggccgcttcgagttcggggcagcgggccaggatggccttgagtttctgctggtcgtcgtcgttcatgcggtcggggttccgggtgatccagccggtcaccttgcggaccccgggcggccgcgctgggggcggacggtcgcccgacgttcggcggaagcgccggaggtagtcgcggacgacggagtaggaccccgtgaagccgcgctcacggagttcggcgtggagcttggcaccgctggtgtggccctcgtgccaccgctggtgcagataggacttgtaggggtccagagtgctggggaggttctgccagcggccggtggccagttcctcccaggtgacggcgcgggcatagcggcggacggtgttgcgggacagctccaggcggcgggcgacggcccggatggtgaggccctggccgaggagatcgtgcacggcggcgtggtgccgccgggcccgctcggccagccggcctgcgtgggagagcggcgggtgcaggacttcagggggtgactccgaggcgagggcgggttcacgaaggcaggaactgtgcttgctgaccagggacttcacggtctcggcgaggttgtgccagaggtgccagagatctgcgacctggacggcatctggggccccggtgcgggcaccgtctgcgaaggcgccgccccggtcacggcagatgatctccactccggggtggtcggtcagccacgctgcgaacgtcgccgactcccggtcgggcagcaggtcgatgggagcatgggtctcgcagtcgaccagcacggtgccgtacttgtggcctttgcgggtggcgaactcatcgacccctagcacccggggcgtctcggcgtacggatcgggcagggccatgaccagggccagcagggtagtgcggctgacaggcaccggcagccgggccgcgaggcgctctccggcccggccggccagggccaccgcgatcgcgctcaacaagcaccgcagctgcggcgtccgacgcccataccgcacggtcagcccgtcgacctgctcggcaaaggtcacccgtgcacatctctggtcgtcgcagaacaggcggcggacggtcagctcgatggacacctgacggccgccgaccgcaccgtcggcgagacggcgctggtatccgctgtgccgtcgcaccgagggcgttgcgcagtccgggcacggcaccggaaccgactccacggttcttgccacaatgtgcaacaccccaccctcggggctcacttcttccaccagcaccccttcgaggtgcggaaacatggtcttcagcagctccccacactcggcgagtatcacgcggcctgtgacggagcgtcaccggcgcacaggcgcacgatcggcttcacggaaatcttgactgagccagaattcaggcgtcgccgagagcttcagtgtcttgttgctgcggcgccttgtcgggtccctggcgtgtgaactgcggatcagcgtttgacgcggttacggacggccaggaccgccaggcccaggaggacgggttcggtcacgcgggacgccatttcgatgtaggtgccagcagtggtcaggtcctgtccggaggagcgaaagaccaccgagttgagcgtgccggtcagtgccttctcgaagcgctcgctggtgaacctgtccccggtggggttttggggatcagccttgtcgatctcgagagtgaccttgccatcgccggggggcacggtgccggtcgctacctgcttcggagagtccttcgggagcccgaagcccatcagcagcacgatggtgacgagcatggctgcggcgagccagcccaaggcccgggaggcgcgcaggccgtagccggacagcagccagtagccgtgcagcaggccgcgttcggtgcgggtgctgccggtgcggtcgtggcggcgcatctccatctcaccgtagtagaagtccgccgcccccggctcgttcctgctgtcctcaaacgccttgcgcagcgcccggtacaccggcgccaactgtgccggtccggcgtgtacggcgccggccactgccgcgttccagcccggcactggtgtcggctggcttgcacgccaaaagccttcttcggcgagggcgcgtcgctgggtgaaccgaagggggcgccagcgccgccagtgcgtgcggcgcgggacgctggcgaaagagcaggtgccctccagccggatctggtccagatgcacggtgccggtgaacaggcatcctgacaggtcgacgtcggagaggaccagatgggccgcgtctaccccccgcagcgaagctatgcgaacttcgatgtcgggcgcgtcgataaggctctgttctgccactggtcgtccgttgtggagcacgaaggggtcggcctccgcggcgatcgtcagggggtactcgaagaccgcatgggcgaagtccaccgtggcatagcgcaggcgcagctcggccgttgacgaccaacgcgtccgtcggcactccaggcagcgcgtggcgaacgacagggtcaccgggcatccgaacaccgccccggacaacttcacccgcccggcacacaccaacggcccgagactggccgaccgctcgaaacccacctgctcgaagcaggcgtcgcactcgaaggttgccgacacgaaggtggcgtccccctggaagatcgatgactcgaacttagcgtcgcgctcgaaggtcactcccaggaagttagcgttgctttggagagtcgctgacacgaagctggtgtcaccgcggaaggtcgcctcgacgaaccgggcgtcgccgaagaaggtagccctgtcgaatcgggtgtggtcagagaaggtcgccgcctccaagtcagtgtcgctttggaatgtcgctgacacgaagctggcgtcgccacggaaaatcgccgacctgaaccaggcgtcgccatgaaaggtcaccaaccagaagctggcgatgccccggaatctcgccaacccgaaccgagcgttgcgctcgaaggccgccaacccgaaccgagcgtcgcctcggaagtccgcacccccgaaaacggcgtcgccctggaaggtggccgactcgaacttaacgtcgccttggaaggctgcccacccgaggctggcggcgctttggaaggtcgctgacacgaagctggcgtcgccttcgaaagtagccgacacgaagctggcgtcgccttcgaaagtagccgacacgaagctggcgtcgccctcgaagcgggccgacccaaacccggcgtcgccctcgaagcgggccgacccaaacccggcgtcgccctcgaaggttgccaacctgaacccggcgttgccttggaaggtcgccgacccgaagtcggcccatttctgaaaggtcgccgacctgaatcctacgtcgcgctggaaggtcgccgacctgaaccgggcgacaccgaggcgggggtcgccggtgtcgggatcgcggagggcatcgaggagggcatcgagcaggtcttggctgaaggaagtaccgcggtggtcgacgttgttgccggggctcaggccggccaggtaggcgtcgcggtcggcatcggaaaggtgggcgaggcatgcagtgtggccggatacgcggatcccgcggcagccggcggggtcctccggtgtggtgccgtggccgcactgcggccacgacggcggggtgctagacggtggtgtgggtgtagcgggcgtcatgttcctaggacgtaccggggccgtcggacagttgccgaatccggccgcagctgtccgttctcatcgaggttcgctgaccgaaggtctctgagctgggagttgtcatcttggggtgacacggttccgcccgctggagtgtcacgtgctctgcggaatgatcagcagagcacgagtgtgtcatcgagcatggtgaggggcggatcgctgagctgtggttcgtcatcttcgccgatactggcctcgggctcttctcactggacttggcagtatccggaagggcgcgagatcggggtctgtggtcttgatgtggccgcgcagggagaagcagctgagaagctgtgctcatgatggacaaggccggtggagttcaaggtcagtcggtttgcccggggaagtatgcacgcgttgagcgtgagagacggttcctgctggctgaacctccgaagccgtcgacggtaacggtcacccgtgtgatcgccgaccgttatctggtgggaacacgtctgcggcttcgacgtgcagatttctcagacggccgctgcgaacgcaaactcactcagaaagtgccggtctctcgtcccggcggtgttcagggcctgatcactaacacctacttgtccccgacggagtacgacctgctcgcgtcgctgcctgccgcggtgctgtccaagacgcgtttcagcgtgcctcccttgggcgtcgacgtcttcgacggtcccctgcagggtctggtcctggctgaggccgagttcaccaccgacgaggagacccagtccttcattcccccttcagagtgcgtggcagaggtgacggacgacgcccgcttcactgggggacggcttgtcgagacctctcgccaagagctgctcgggtggctggctgagtacgggctccgcccgcagtgacatcaaagacggcgctctctccgcccgccacaagccccaacgacacgagcagcagtctaacggggccgactaccggtcctcggagctccttgacctggcaggccaaggtcacggggccacctatcagtcttcgcgggattgatcccgagtctgcgtgcggcttcctggcggaagtcttgatcagcaggccagtgcggtgaggtgagcaaagccgtgagcttgacggtctcggggtagattgcgagttctatccggggctgggaggggcgacgggggtctcgtctccgtaggggtcctcgccgagctggtcgatgcgtttgttccagcgttgtcgcagagctgacggctttccgtcctggaaccagtcccggaggcagtcgcgggcaacggcgtactcccgagcgaggatggaggctcgggttcgacggacaagacggcaatgtcggcggttggcctgttgcagttcgggcagggcgtgaaggcgatactgctcgtcgccgaggagccaacgctggtgccgcagacagacggcttcatggggcgggatggtgcggaccacgagcccgtgaaagcctcgtcgggccatgcaccggcggcaagccggacgccggagcacttcgacggcctggccgctcagtgactgcagacggttctcggccggttcgccgatcacggcgagggctgggatcgcgtgagacaactcggcagccgttcgccccgtcagggcggagagccggcagagggtctcgggtgtccagcgaccggggcggttgtcgtcgcggcggtgatgccggttatgcccgagcaggatgggccggaactggaccggcaggcggttggcgtcggcgagccggttgagataagagcagccacttgactccctcagccgcaacacgacatgaggcaactcagcgtatgtccacagaacatcggtacgccgcctacatcggaccgcgcaccggccgccgcctcgccgtcacctcctacccgtacccggcggccgaccaagggggtgcggccgcatgaacgccaccgcccgcaccgcagccggcctgggcttcgagggcatcgagctggtcatcaattggggattgggggtcgactcccgcgtacttggtgaagatgctggaggacccggccgctcacggagtcgacctggactgcaccatggtgctgcacgagctcaccggggacgagtggccggccacccgcgcccacgccgaggagttcgtgctgccgcaccttcgcgagcaccgtgtccggctcgttcaagtcgcccgggccagccgctcgttggagatcacggtcatagacgactcccgccagccgcagcggatcgtcgagcgggggccctgggcactgtgggatgagtacgagtcgggcggcaccgttccccagcagggcggtattcggctctgcagcctgcatgccaagggcaactggcggatgcccttgtcaccgactacctgctgaggaacaccgcgcccgcacgctgtccaatgacgcaagcaccgacggcggtctcgacggagggcgtgatcactcctccgtgcgccgaaggagtggtctccaaactgctgggtcgcacggctcaggcgatggccgtggccaggagcgtgagtctcgcgggagccacccccatgtcgaaccgtgtactgggaggacacgcagagctgatgactcctaaacaagcgaacctgaactcccgccaaccccttctggccagctgatcagcacctcccccacaacgggggagcctcaaccgtgatgacgctgggctgcgccccgcaccagatcgctggtggttggggcgaagcggcgtctagccctcgtacttgaggggtttcccgaggcggacgatggtcgagcagtccagttgctgctggaactccgtggaaccctgccggtaccagtagctgcagccggacagattgtcgtggatcgggccggtgaccttgacccgtgccacgtagtacacgtggctgcccgttttcgctttcaccgtcatgggatggccggcgtagttgcgagccttgaacaggtcgcccacgctgcccttgccgtcggtgcgtgcgaacaggacattgccgtcggtgtcgtcgccgttgaaggcccggtactcgatgaccttcagacccttggggacgtgggtgaacttcgcccgcgtgatctggatgtctttgccggactcgttccaggggagcggcagtccggcccagtactcctcgccgacctgggcgtgttcgtagccgacgtcaccggcggactgcatgccgccgttgagggcgtctccttcggggatgccggtgttctggccgccggtcagcgtgtaggcggcggccacggcgagaaggagggcgacgaacaggccaagggttcgtctagttggagtagaagacgccaggcttgtcgtgaaccggcccattcttcccccagatcaggtgtgtcgcgttcctacgggtaccggctatgatcttctgcttgtggttggtgtcgtagccggtggtgacgccgagtccgacgcccatgaagttgacggcgttgccgaacttggcactcttcttcctggtcagctggaagtacgtgccgttgtcgaccttggcgtggtagctcttcggggccctgccgtagttgccggagccgtccttggccgacacgtccttgccgatcttgccgacggagccgcccgaggggaccttgtagcggccgggctcgatcgtgtaccaggtggcacgcacggtgccggagcagatcctctgcttcttgtacttgttgtactcgatcggcacctggtactggtgggcgtagtaggagcccttgttggggtagcccgtcgagacgccggtctccgacgagatttgcatgctgccaccgagcttccagtcgccgttgctgttgacggcggtgtcgatggcgctgttcatggtgtcgtcgtagtcgaacgaggccttcgagtcccagttcgcgtgtgcttcaccgaccaccgtgtacttgatcttgctggtctgcttgtacttcaccgtgtcgcacgatccggacgcgtgcggggtgaccgtctcggcgctgatgtccttgccgcccacaagatacgggttgtagctggcggccagggtgctgtggtcgctctgccacatcggcgtcatctcgcccgtcgcctgcgggtcggctttggtctgggcagcgaaggtctgcttctcctggtcggcggtgggctcctttgcggcggtgtcgtccacggtgtccgggatcaggggcacggtgtgattgtcgttgatcgcctctgcggcccgggcggaagcgtcggtcccggcggcgagggcggtcttggactgctcgggtacggcggtcagcgtgtccgcgccgagtacctgtacacccgaggaggtggtggccgtggtggtggcgttcaggttgagcgcgccgccgttgtcgtccatggcttgcttcacgttcgccggcagcgtcgagggcagggtcagcgtccatgcgccgtcggatgctgtagtcgccttaccgaggaggggctctgtccccccggtggcggtgtcactgcccgtgtcgacgtccgaggcagtgaccatgaccgtcagccctgacgccggctgcccgctgccgagggtgaacctgccggtgatcgtgttcgacggcgtcgacggtgccgtgtccgaggactcctgcgcggtggggacgtcggtgtcggcgacgggcggggtgccgaagtaggggaccgtgtcctggtccgggtcggtcaggcagggacctgcatccgccatgacgtcgccgaggatgcccgagcgtacgtcgctgtccgcactcgtccatgggccggtggtgaaggaccggatctgcccggtggtgtccggatcgctggtgaccgactgggtgctgatggcgttcgggccgggtgcccatgcctgggcagcgtcaacaccggtggcgatactggtcgctgcctctagcctgatgccggggccggggggcaggttggcggggcccgggggcagcgacgtgacagcggcctgctggatcgtaccgtccttcagccactgcaccgcggaattgatcatccacgcgtcgtcggcgtcggcgatcgcactcgtgacggacgactttgcgccgtccatgaccttcgtgatcgtgccgtcgccgctgtccgggctggactgcttgtagacgtccatcgtgccgtcggaggcgatcaccaggatccagtggccattggccaggatctgcttcgccgacgaccagttgaagctgtaggtcttgaccggggtgagcagggaaccgccggtggcagtgttgtccttgtacgacttcacctggccaccgcccgtggcctcgtagatgatgccgttgccgccgccggtgaagaccttgctggtcatcggcaggctcgccgtgtacagcgtgtccagcaagtcagtgtcggggctcttcggtccccactccatgtacttgtgcagaactcgcttgctggcggcgttgctgctggtggcgggctcaaagacgtacgtcgacacggagtaggtagtgcagctgacatccgcagcggatgccgggtggcccggagtcagggcctgcggggcgacggtcaggccggtggcgagcacgatcgtgctcagcacctgtatggccgtggtcgtgccgcgccccctcgaaacagaagacattggttcccccaatgtgcaggcgagctttggtcggtgctcgcgtcgccgaacatcaaaccatcaccgaacgcccagttcagcggcacaatcgggagattcagttccgcttcttctggttgcatgtccgcatttggatcttgtgtatccgatatgagaacgccgattcttgagcttgctctgagcttccccggcacggactttgcgagatcaacacgcacatcatgcggtttacttaccgagcagttaccgatcggtaatgagcgcggctcggcttcgacctgtaggccaccgaacagccgcacgcgggaaccaggccccggcgactactgccgccgaccggcttcggatgatcgacagcgggggcgccagtgtcggcggttcctcaccctcgcgatcacgagtccccatggggaaggcggttttctttcgggagaacgatgttcgccagtgcgcccttggaggccctggtcgtgcccttacgatgatctgatgcgccaggccgacccgaagccgtactggaacaccaacgtcgcccggcacccgggcatcctgcgtgccgtgcctaagaccggcaccgcttccgcgacggcggcccagccgctgttggactacatcaaccgccggtatccgctcacgcagacgaccccgctggacgccaacaggttcagggccaacgcggtacccgaggccgagcccggggacatcatcgcctacgactggcagaacgacggcgaggtcgaccacctgtccctcgtcgtcgacatcgcagacgggcagtatccggagatcgccgagtggggtgtcgtcgactggaacccgctcggggtgatcaaccggaacgcgaccacgccctacgccaagcgcggctggacgtactccgagaagaaccacaactggctccagtcggtcgaggagacccggaacgtctcggcgaagttgatccacatcgacaccaggaacgtcaccaccttctgagtgccgacagtacgtgcatggccccgccgctatggcggcggggcctttccatgcctgtggcgttgcagaagccccaacggatggactgctaccccgagatgccgcgcaagtcatgcggcctgcccgcacccgtgcgggcgttctacttgctaacgacgagcttcttcatctccgtggtgagctcgtcgcggcgctcgtcggaggtcagcttttggtcacgggcggtccaggcgagtgcatcgatagaaaggcgatggtcttggcgcccagttcatccgcgacctcaaggcagcgccggtagcaggaggcaaggccttcggcctcgccgtactccctacctaccggaccgtcggtgtggatcacgtgctgaccggcgggttgaggtcgaagaccggcgtcgccattgcgtcgccaggctcacatggaccgatcgcggcaccctcgatcgcgagacgttgaccacgttaaggagcggcgcaccgtagcactttggtgcgcctgcttcggtaatttcgcccggatgtggccagtgcccgaatccgatggaatcctgggcttacacgccgtgaaggattgtccgttgtgagggggcacggatgcaggtgtgcccggctgtcgtgatcaggggcgggaccgctacggcggctgccatggtggtggtcctgggcttcggagtcgcggggtgcggtacttcgggcgggccacctggcgggaatttgcctgacggtgtgcggacaccgggagtgacttcgtccgcagcgacggtccccggtcaaaatggtggcggaggatctgtcagcggccagaacgacggcggaggatctgtcagcggtcaaggcggcgggagcggatccgtcggcagccaggacaacggtggtgcggcggctggggacccgggtattccctccgtggaaccgccgccgacgtataccgagccaaccgatgggcccggcatcggtgtcaccggcagcccgccggcgacgcaagtaccaacgccctcatgcagcccaacaccggccccaggcgagacctgtgggccgaaggccgggagcctcattacgaggccacgaagacggtaacggggatctgacaggtccgaatcctgtcgatcggggtaagtacggctcgaagatccacttgatcaccgagcggaccggtctgcccttgtccgtcgcaatctcgggcgccaagctgcacgacagccaggccctcaagccccttgtccgcggcataccgcccatccgttcccgtcgtggacgccggcgacgcaagcccggcaagctccacgcggacaagggctacgactatgcccacctgcgacgatggttacgcggacgcggtatcaaacaccgcatcgcccgcagaggcatcgagtcctcacaacggctcggccgcgaccgatgggtcgtcgaaaggaccatgtcctggctcgccggctgccgacgactccaccgccgctacgaacgcaaagccgagcacttcctcgccttcaccagcctcgcctgcaccctcatctgctaccgccggctggccaaatgagatgattcctaaggaggttgggagccggaagtgaagtggacgtgctgctcgccgccgatctggaaggcggcggggccgttgcacgtgttgccggacacttcggcggggccggcgtccgcggggccgggctatgggcgggcctgggccatgagtttgctgagctccgccaccgcctggtcgcgctcgaccccgtccaggtcctccagcagggtctcgatccggctctgccagacggcctcgtgccgcacccggagccgctccacctcgtcctggccggccgtcgacagttcggacgcgctgcggtccagccgctccagctcacggctctcccgcaccgcgtccccacgtccgaaccactcggcgacccggccccgaaaaccgttccacaggtcagtccccgctgcctggaccactgcagatccgcccgccgccgctgccgccgataccaactcgtccagcatggcgcctctttcaactcccatggccctgcgggcattacgaccctagcgcgcgaagggcgcccgcggagggaactcgcacctggtcggtgcccggcaaggtcgacgccctcgatggcgtcagccgctgcggtacggagcagcccagcgccgcgtgggactacctcgcctcggtagtcccctgagccggtcccccccgtctcccggccctctccgccgcgttgggtacgtcctgcttgctttgtgggctcaccccgacctaatatcgtcatcatgacgataaccgcccagtggtccccgctccctgcaggcattgactccaggggcttcgagtccctccacggactcgaagcgcacaagtacgtggcccgcggtcccgccgtccacctcaatgcgctgcccgcggccgttccgggctgtggggcccacggccatgttgggatcggcgacggcctcagcacggagaagtgatcatgtttgaaatgccggtaaatccctttgagctctccgaagaagcgctgagccgaatatctgccgatgactcatggaccccgatcgaatcagagatcccaaaggccaacgccaaggtgattcgccatttcctcactccggccgaagtggaggcattcgcgaccgaactggccgcccagtgctttgccccggtgggccgagacggcattgccgccaactatgcagagggagatccggtcgctcatctccgcgccacggccgaatccacatccctggcggcagaattctaccgcaggctgcggacgcttctatcgcttgaagtgggatcggacgatccgacggattcggacggaaggccctggaggccggtggccgtcaatccgcgtatgcgcttcatcacgtacgaacacggcggattcattgtcccgcactacgattcgccctatttcgccccagacggaaggcgcactctcctgacggtcgtcgtctacctgtcgtatgaggccgtgggcggagaaacgcggttcatcgccgataagcagaacgatcttccctttgcgcaacgtgacttctctgactggccgcggctcgcgaagcctgaggaaatagtgagtgcccaccgcccagaaccgggcgatgcgctcctcttctggcatcggacgcttcacgactcggccccgcttcttgagggtacgaaaacaatactcagaaccgacgtgctctacgagcccgtagatgtgccttgagcagcggcaaggccaccgtcgcgttgtccctcaccccggagaccgacgtccggcacgccgtgatcgcccacctccgagccgggcggcatcgggccctgcccgcggccggacatcgaatccactcgcaccgaacggcagggagagcagcatgaccaacgggaggatccacaccgactgggtggagacggtgtctcaggacggcctgcacctgatgcagacgcgcttggaggtgagagttcctacgtctgagggtcgcaagttcatcacctgcggtctggcccggaagacgtatgtggtgaaagacggtattgcttgtcgggtttcgtcctacgcactcggccgcgacctgggcagcccgggcaactacgacttcgagatcgtttctgcgacggggggccctccgatccggaggttcttcaactgggacggcgtgccggccgagatactcgagggcgctctcttcgacgcgcatgaggggcttgacgatggcgagtacatcgtccggatcgcggcgggaatgacgaccagctgggacagcgggacgggacagagcatcgagctccatgtcccgtgccacgaactcgcattcgtcgtggtgggatccgcaccgcaggaggtgcgcgcgcgtaccggcggcccgtgggcggcgcggccctccgtggagatccccgtggtcgattggcgcgatcagcccacggcggaggcggcatgggaggcctacctgaacgggagcagaatcagtctggatgcctacgggatcttctccccgcagcatctgatgaggaatcaacgggataccgctctggagattctccggagcgagggctacgccataccgcgaaccccggaacccgccgagacgcctgggacctggctgggccactggggtggagcatggatgccggccgatgtactcgcggcccttcacaccgtgccggacgacaccgcgcaacgtgcgtggtatcagggagcgaaggaatccctggacatcgcatgggatatgcacctcctgtggaccaccgacgtgttctgaccgggcccgcgctccgtccatgaccaccgtggcgggccgtcggcagtcaccctgcaccgaggtgccgagtaccggccgcggcccggtccgcctccggcctgactgccggtcgcggcccgggcgaggatgtacggcagcaccagaaggtgcgcccgcgaggttgcgccagcgcggcatccgccaccgcatcgcccgcaggggaatcgagtcctcgcagcggctcggacgccaccgctggaccatagaacgaccatggcctggctcgccggctaccgccgactccaccgccgcgacgaacgcaaggccgaacgcttcctcgccttcaccagcccggcccgcaccctcatctgctaccgcagactcgccaaatgagatgacctctttagtgttgccgaatgacgtctccggacgagccggttccgcaagatcgagcggatcagtttcgagatccacgacggcgggttctccgccatcgacctcaccgcccgccacccgcgcaccggcgagctgctgtcatggggcaaaccctcgccgccgccggcggacttcagcgcgacctccagcgcgagctgacctatgacgggctacgcgccgccgaggccaagggcagcaagggcggacgccgccccgccgtggcggccgcgaaagccgagaccgtgcgcaccgcatacctggaaggccgctcaatcgccgccctcgcgcgcgaccacggcgtcagccgcggcgcgatccgcacggccatcgccgacctccaacaccttggcgagatggagtggatcgggcccgtgggtcagggcctcttcggcgcgacggacggcgggcgcccctcgcaagccgccgcccacgccggcctagtgtgatgcgccggaagtcacggtcttaagttccttgctggttctcggtggctggcggagttaccttactgaggtagtcggtgagggacttgaggatctcgtcggcagtcttggtccaggtgaagggcctggggttctcgttccacgagtcgatccaggccctgatgtcgtcctccagcgctttcacggaggtgtggacgccgcggcggatgagtttgtcggtcagcaggccgaaccaccgctccacctggttgatccaggaggagccggtcggggtgaagtggagatggaaacgggggtgcttgaccagccacgccttgatctcgggggtgttgtgggtggcgttggcctgagtgtgtcagatgccgatgagcccgatgagcgagatcccgtcctggcggccaccgacctgggccgcgccgatgtcgagcgccgcaggttcctcgcggtggccgccttcagtaccgccggcgtcgccatgccgctcgctcacgatcacgaggccaccgcccgcatgctccgcgcccgcaccggcacatctgtagtcggcgcggaggacgtggacgtcgtacgccagatcactgcagccttcagcgcggccgacgaacgcctcggcggcggccacggcctgaccaccgtcaccgcctatcctccgaggtcgcttcccgagcgaagccatacgccaggcggcgttcggcgccgtggccgaactcgcctacctggcaggctggaaacaccacgacctcggccaggaaggcgccgcccagcgctactaccaggtcggctaccaactcgcctgcgaagccgacccgcacggccacgccgcctggatgatgcgcgccctcgcccaccaggccctcagcctcaaacagccccaccactgcgtcgacctcgtcgaaggcgccctcacccgcggcctcggccacgtcgacggccagaccgaagccctgctctacatcacccacgcccgcgcctacgccgtgaccgacgagaagtccgcagccgcccgcgccctgctcgccgccgaagacgccctcctgcgcgacgacgtcccccagcccagctactcccgcgtcagcggccccgcagccggcagcgtagccagccacaccgcccgcaccctcaccgacctcgccgacctcgccgaccacgctggcaccgaacaacagcaccgcgacgccctgatccgctgggacctaaagaagtacaagcgcgtccacgccctcacctacgccgacctcggcgacagcctcgccgcccaggcccgcgccgacgaggccgtcgccgcctggtcgcaagccctcaccctcatggaaggcatgacctccgaccgcacccgcaaggcgatcacctcgctccgctcccctctctctgtctaccagcgccgcaaggtgcccggagccgtcgaactcgcccgccgcgcacgacaagcgctggcctaagctgcccatcaaccggccgacgaagggacaccagacgtggctcagcggacaacggacgacctgcccaacgccctgccgcccgccctcgaatccatgaccctgctggtcgccgccgtcatcgtccacgaccaggccaccaaccgcgtcgtcctgctccagcgcagcgagaacgccaaattcgcccagggcatgtgggacctccccgtcggcaagagcgaacccggcgagcccatcaccgaaaccgctgtacgcgagttgcacgaagagaccggcctgaccgtgaagccggaggccctcatggtcgcccacatcatccacggctcctggggcgtcgaggctcccaacggctttctgaccgtcgtcttcgccacccacgaatggaccggcgaacccgaaaaccgcgaaccacgcaagcactcccaggttcgctgggttgacgccgacgccatccccgaggagtgcgtggacaccaccgccagcgccctccaccactatctgtccggaggagcccaggtgtcactggacggatggctcccaaagtagtcacggcgtagcccgccagtcatccaacctgcgaccgcgcgacgtaccaagcgaagtcgtgggcggctctggggtgtgcacgcactgctgatactccacgctgcgggctaccggtgggaggtggtcgactcgcttgcagcgcttcggctggcagttcccggccgaagcgctgcatacaccgctcgctcacgcgtcacgcctctcggtgtgcgagagtcgatcaccgcccgcgaccagtccagcttcttcgcggcccgcagctttctcagcagcactacgtgcagttcgtcccaccacgccgcccgcctcctccaggcccagcaggacggcaccgacgaggacgacctccgccagatcgccgccgaagcgctcggcgaggtctacttccgcgacaacggccgccgcgcccagagcctcgaagtgaaactcaccgacctcgtcgacctcaagttcgagctgtaggcaaggcagtacggcggctgcggctgttgaggcaggatcgggtgtgcccgccgggctgtgcgtgtggagccggtgcggtgcggacgtgggcggctgaagacccagcgcagcacttcctggtccaccagggggcgttctgtgcgggccagtgcggtgcggacgtgggcggtcagctgggcccaggcgcggaagttgccgtgtgcggcatggcggtcttcgtgcggctacgcgaggacgtgaacgtggagcatgtccccgccttcggcgcccgagcctgaccggacgccgaccgtcgcctcaatctgtcgcgcgcttacgcgtcgtcctcttggccctgcgtcggaacttcggcgccggcgccgttctccccggctggcatgggcgtgggcacggcggtggaatcgcacccgcggccgcgcaccctgttgtagagctgggtcccggcgatgctcacactcgcggcgacgatggcgccctgcgcgcggccgatgaggaggccctgcgcgcggcccatggcgatgccctgcgcgcggccgattagggccccctgcatgcggtagaaggcccgcagtgctgcgggcccgcctcgcttcccggcttccttggtcaactccgtgtagacgctggtcacgctctgcctcacctgatttcgctcgcccaggaacaagaccgatgttcgcagcaatgcccccgggatgtcgggcagttcagcaaatgccacgcttcacggtgatggggctacctgagatttcagagatccccatcacgccctccaggaactgctcgcactccgcctggtctcgccgagaccagcccgtccccgcactccccgcgcagaaggcaaccccctcttcggccctctcggctcgtgcagctgccgcaggcgtgcgggcccggctgtcagtgctgtgggcgaggatcactccatggccagcctcgacgaactgcccccataccgacgcgcgcagttgctgtggcgctgggcgcacgagggggtggcgttcgtcgagcacttggtcttcgacgccgcgaaggaaccctgctgcctgccctctcccccgccggggccgccgggcaggaccgtcgcggtgcccggtgacgacggccggttccacctcgagcgtgcgggcctgatgctgtgcgggcaggccgaggccaccggcgcctggggccaccgtcagcactgcgggtgggtcgagcggtgggacgggccgcaggagtggagaggcggccgcgatgacggcacgtcggtctggggctccctcatcgtcgagtggccggtgcgggcgagcggcccgggcgtggacccgggcagcgtcgaccggcccgagcgctgccccggcggcgcgtacgagctgctgcacctgtggcctccccgcccggcccgtacggcatccgtccggcgcctgcgtgccgcgctggtcgacgcgctcggccccgactgccatctgtgcggcctgtaccccggggcgatggtcgaccatgaccaccagacaggtcgggtgcggggactgctgtgcgcttactgcaaccggctcttggaggaatgcccgcacctcaccgactgccccagggccgactatctgctcgcgcccccggccgacgcgctgaacctcatgtacccggccggccagcagtggcggcccaaggaatccacgcgcctgcgggtgattgagcagctggggttcgatccgttcgaggacctgcgcccgcccttgtaggcgccgaccagactcagctctccctccaggggccacaagcggggcacccatgcgggcggtgtgcccctccgctcgacgctgatgatcgctgatcagttcctgcggaacacgagtgcttccggggccggttgggccgcctcggaggcgccttgtcggggcagccgcggttgcggtcgcactccagccgacggcgctgcgcgaacagttggccgccgtcaccgtcaggaacgggagccggtgatggcggcgggcccgctctgcgagcgtggggtcttctcgctcactttcttcacctcgatggtgtgggggtccacggcttcgccgggggcgccttcgcggtacaggccgctggggaggctgtcgcggtcgtgcgggaggaggaagaagacgcggcgcgtgtacaggccgctgtcggggtcgggttgcttggctggccctgcgacgcgagggagggctggacgcgctcgtcgaactggtgcagtggcgggccgagaacagtgagcaggaggaggtgtggccgcgtgacctggagcatctgcgtgagctcgccctggagttcaggatcatgcacttgaagagtgagctgaacgccgcgctgggacggttcagcatcggcatcggcggcctggacgaccgctaccccaccatcctctcggtggcgttcctgcagctctacaaccaccttgccgaagacgccacgatccgcgagtgcgccaacgagacctgccgccggaatttcgtacgccagcgcggccgcgccgagtatgggcagaaccgcaccagcggcattaagtactgcactcgcgagtgcgcccgcgctcaggcgcagcgcgaactccgccggcgccgcagacagcagaactcgccgctccagcaaccacggtccgagaagccggcgccgcaggacagtccggaggcggtcggccaggcgggaggcgagcggtgatcagtctgcggaaccaaaacccggagcggcaagctcaccggcgaccaactcgcctcgctcgcgaagccagcatggactgggtgtaaggggtgggtgggctccggtaatggagcccacccacctacttcttctttgggcgccgtacgacacgcggcgcccggggagcagccagtcgagcgatcttggtgtcgctggccagcagcgccattcgttcggcctggtccaactcctcctgctcaagaaccgcctcggcgacatctggcaggcggtcgtcggggcaggctttcaggctggctaccaggcgcttgtgcttggtgtcgcccgcgctgggcgagggaaggccgaggcgctcgcacagcgccggcagttccttctcggtgtagcgcctgtactgcgtgaggagcacgccgtcgatcagactccgcaaccgcgccgtgtccatctggccccccatcccatgatgatgagcgacacccggacacgattccaccccaccccttcaccttggccagcaggcaaattcgcagtgcgcccgcacgccgcccctctaccttgatgcgcatgtcgcacaaatcgatccacgagcacctgctgatatcggcccggaagtgggcgcgcacggcggtcgacgcgtacctggaggagcccatcgaccaggacttcgccgtgcaccacatggcggtcgcggtggaacacgcgtccaaggcatacctggcgtccatcgctcccgtgctcctcgcgtcggagaagcaaccgagcgtcgacgacctgctggtcctgagcgggaacgaggacaagacgaagaagggccgcgccgggctcaagaccatcggcggcgagggcgccatcctcagggcagcccagctcctcggccccgggcacaaggggcctgccaagctcaaggaactgagggagtcgcgcaacggcatcacccacatggggtggggccagcccgtaaccgagtgccgcgaactcctggccgcgggcatcgagcacatcaacgcgctcctgaaagctctgtcgacagagcccgacggcttctggggcacacacctcgaagcctgcaccgcgctggtggcccaggccatgagcgaaatggagatccggtatcacgcgaaactccggcaggcccgcgagcggttcgccgagaccacccggcgcctgtccgaagccgagatcgccgagcttgccagcagtctctccgctctgccgacagcgcactcttcgaggagcaaaactgaggcgcggacagtcgagtccggctccctcacgcactgggaccatgagacacgcgccccgatgagctgcagcactctctcggcccgggtgagctgcatgatgtgcgggccggcccgggccgcgatgcgtcgagcgcgtcctcgccgatcctccgccgcccgtcggtgtgaaccgccgccgcaccgcgctcggcgccccggacaaagtgaccgtgcgcgaactggcaggcgtcccggcacaagcgctgagcgattaccgggaccggcacaccggcgacgactccctcgtagaaaaggctctcctcgcctgcgccgcgagcggacacaggtccgaggccgacttcgatagggtgctgcggcgtcacaccctccggacaccgtgctgctccctctcgccgagggcctgcgcgagaacctcggcggtgcaccgacatggcgcgaagcctgggcccgtctggtcctggccaggccgaacacccagcggcccttgtacgcgctctaccagcctggccggcgctgcacgcccggggggatcgctacgggagcgcgcatccgtcggtggtcgccgcggtacgcgatgccctgggcaccgaccaggccgcgtggaaccggttcgcgacctgcccggcaaccaactccggaccgaccgcctggctgcgcctcggtgacctcctggacgcggctgccacgggagcaccctggccgaagccgccaggcagccgataagccctgatcttcgcccagcatccggcgaacgcagggtcggggtcaggtcgcgggccgcatggtcgcggcggcgcagctggagggtgaagacggcaaccgcgtcgagcagggcggcgcggatcgaggcgccgtccagggtgtgccggggaagggcccggtgaatgctcgcggtggcgggcagggtgcgcgggacgacggggcgggggtcgatgccgcaggccccgtcatcccgcaggatctcggcgcggtgggcccgatgccgtgcagggcactgcccggcggagggcgggtgagaggtcagccgacgatgtcgacgccgaaggcgcgggccaaggcggccagttggtggtcgtatccctggccgaccgcgcgtacgcgccaaccttcggccgagccggactccgacgcatccgcttccacaacctccgccactcgaccgcgaccctgctcctggaacagggcgtcgacctcgtcgtgatcaaggaactcctcggacacgcccacatcggcgtcaccgccacggtgtacgcccacctccgactccgcctccagcgcgacgccatcgacctcctcggcaacgcccttcgcaaccccgacgagaccgccatccgacccgacgacggtgacggacccccactttgtgcagcacccgtccactgacgttgccgtcaactactgccgtcagacgcctcaggagccccgctggagacagatccagcggagctcctgaggcaatttatgcgcacctacgaaatcgaaaagatatggccatctacgctcaccaaagaggacagtagcgccgctgctgccaggccaggcaaaatccgcaagcgattcaactcatacctgatcctgtgaggcttcaaatccgtatggattcttcccgctcaccagtccccagatagggtcgccctctaccgagcgaatccactcctcgaaagatttcggaccatctcggaaccaccaatcctcatgtccgccgatcaagccaaggttcggatccatcgcgtaacgatattcgagcaggacttgggagtagcactcatgctcgcccttcacatcagcaacagcaagctggcgcacgaatcctacgacgaaagttggctccggaagccagttcaccttgccatactggaaaaggaacccgtcggaatccggggaatccgggacgtcgaactcgactagtgcgaaccgccggaccgcctcgtgcagctcggccacagtcggcactgcagtcccttctgcagacagactgagcaggtctcgtgctacatcaacagcagactcaagcgactgcctcgcggacatgcttcacccttaccttcctctagtctcgaagccattacagcagcagccccgccgccgcgagccattattgcggctcgatggcgacagggcgacggctgggtaggcggttgctctacggccagtagcctgcgttcagctgatttctaatatgatttagaacatctctggcctcattggcagtcctcactcccgacatcatgtcgtttacatagccatagtagttatttgtgtgaatccttgagtgcacagacgcaccagtcagatttggcgatgccgatccgcgcggcaagaatactccattgtccgcatcatttatatcaattccgacgctagccaatttcgcccgtgcagacgcagccttgggagatgcacttgccacaatgtgatgcgccgccgtctcggccggccgaatggtacctgcggccgtcatgttgtcacccaaaatctgggcattggtcgagcaactggaattatggaccaggactggcgtggtaccggcgagtgcatagtacgtgtgcagatcattgactgtgaggttgtacgtggtggcgtgctgggtaaatgcccggttgcccgtgacgatgacggtgtcaccgtcatcggtgagcaaggtcatgcccggttcaaggctcccagctgtaatccaggcactctcggatggcgaccagaaggggtgttcatgggtcgccgtcaattcctcggcgccgtcttccgtggcgatggagagtttgttgaagtgcttgtcgcccgtagtggtgatgagacgggtaacctcgcgaggtccggtttcgccggttttggggtcggtggcctggaccttgtctccgagttccacctcctcgatgtccttggtcgatccgtccgccatgaggatgtcagtaccagccaggaagcacttgcaagggcctgccgccttcttggagctgccccgtccgttggttccgggcagctcaatggctacggcagcattgagcatgtctcgttgcgggtcgatgccatcaggacaacccccgacgtcctcacacgcgttgtacacaacctgcccgacgcgaaggtcggcgagggggtcctcgtgtggcttgtagttccagtcggtccaaccagccggccagctgacgatgatttccgcgactcggtcgtagaactcttgcgccttatcccagtccgatggaacgacgccagccagcagataaccgccattcccgctgttgcacgaagtgcaggcgtgctctcccgggtgctggcccgtgtaaccggcacgctccccgtcgccggcgacagggtaaccgtcaccgcagatgtcgcggcggcacagaccggatggatcgctgtaggagatggggttgttggtcgcgtacgagtaggcgttgaggttctgcggggcatacggcgtggccagggggtccgggctgaggaatcggcccaggttggggtcgtaggcgcgggcgccgaggagggagaggccggtgctggtgtcctcggtcttgcccaggaatccgttgtcggtgccggtgggcagggtgccgctgcgttcgtcgccgaagggggtgtagcggcggcgggtcgaggctccggtcgatgcgtcgacggcgagttgggtagacgcctgggtgtcggccatcaggtaggtgaccttgccgttggtggccgtggtgccctcagtggtgcgcatggcgaccgttgctgtaccgctcgcgtagacacgggtcgcggtgacggtggtgccgttggtggtgcgcagttccatgccgtcgatggaggcgacggtttcctgcggggtggtgcggacgaggatgttgccgtcggcgtcgtaggcgtagcgggtgagttcgctgccgctggacttggtggtcttgactgcttccagctgtccctgcggggtccaggtgtagtcggtggtgatgcccggctcgacgcgctgcttcattgtgccgtcgtcgaagtagtagagctggtccgacttggtggtggtgctgccggtcttgtggtcgatcttgcggacaccgtggggttggttggcgttggcggtcgtccaggtgccggtgtcgtcgtagccggggtagaggtagtcgtgcagggtggcggtgccggccgagtcagtgttggtgatcgactggaggttgccgagacggtcgtaggtgtatgcggtctggtagggggcggtgcccttgaagtcggaggcggtcttggtcttgtcggcgcagatgcccgtggtggtgtgggtgtaggcgttggtcaggcgggcctggtcgtcgtaaaggaagcactgcgactgggcggtctggccactggcctgctcgcgcagctcggtcagtttgccggcgaggtcgtaggtgtaggtgtccttctgccgctcgctgactaccttgttgagggtcgtggtcgttgccacgctcttcagttcgcgggttccgttgctgtcgtcgtagctgtaggtgcgctgtgccgctgctccgatgccggggaggacggagtcgactccgtaggaccggtccgtcaggcggtcgtaggcgtcgtagccggtggagcggatgtatgtctgcagcgcggattgcaggcgcagagggcgaccatagccgtcgtacgtcgcgttgacggtctccgcggggagcccaccggctgccgggtaggccaccgaggtgacgtggtcggccgcgtcgtaggtgaaaccggtcgtgtagctaccggcgagacccttcacggtgtcggggatggtgacggtcgtcttcagtgggcggccgcggacgtcgaactcgccggtcttggtggtgtaggtgttgccgttcgtgtcacggctggtggtcgaggtgatctggcctttgccgccagtgatgttcaggccgtcccacgtccaggcggcgagttcggtgtcgccgctacggaccgccgtcttacggccgagggcatcgtagccgtagtccaggacagtctttccgccattgctggtgatcttgctgatctggccgttcttgtcgtactcggtggagctgaccccggcatcagagtcgtccgtggcggtgcgctgaccagcccagtcgtaggtgtaggaggtgtcgtttcctcgagggtcagtgatcttgatcagttcgtctttggccgtgtacgtgtacgcggtcgtgtaggtggcgctgccggtgtgttcgacgaccttggacacctgtccgtagacatcggtgtatgtgtcggcggcagcgtcgaccttgttcttgacgctggtgaagtcgccgtcgtaggtcgtgtccacgcggcctgcatcctgcgaggcgccattgacctggagccgtgaggtgatggcacggcccgcccagtcgagtaccaggtccgtgtaggacggaaggtcctcgaccttggcgctggaaggtccaccggagcccgccgtgccctggttgcggaagaccgccgaggtgccggtcacgttgccggccgagtcgtagcgggtgaccgagacctgccggttgggcacctcgttgcccgtggccgcatcgacgccgttccccatgggggtctgcgtctcccgggcacggcccaggccatccacataggcgtgtgaggacaggtatgtcgtgccggactgcaggacgtgcgtggcgacgtgcgggtagccgtcgaccgcgtcgggcactccagcgctgttagtggaggtggggatggtgtagctgaacttcatcgacggtgagctgccggtttcggttggcctccacacctccaccagacggcccgccgcgtccaggctcattttggtgacgttgccgttggcgtcctgaatcgaggtcggcttgccccagaaccgggatgtccatgctgtggacgtgagcgcggtgtgggcgggcagagccccatcggggtcgggagtggtgacgatgacgccgttcaacggccaggtgttggccgggctgtacttcgtgagggtgcggttgtggcttccgtcctcgctccacatcacacgccccgcgtcgtcgtagccggaccacgtggagcgatagctgcccgactttgtataggtacgggactcggtcgggttgccgtcgacgggcttgttggcgtcaacgctggtggcgttgtcgtacagcgtcgacgcgtagccgtcctgcttgctgtcggcgatgctggagcaaccgaccgagtagtgcttgacctggtcctggagcacggtccaccgctgggcgccggtggagtcgtagttgtcggtgttgtaggcgcgaccgtaggtggtgcagcggttgtcggagacgctgctctggccccagtcgtcggtgcgcatcggcaggccgaatgtggtggaggcgccctcggtgtcgtcgtactcggtttccaccgtgtgttcgcgccagccgctgctgaccttggtgttggtggtggtttccttctcgcggacgaagcgggcgtcgggcagtccgtcgtactgggcggtgttgtggtcccagtacttgtggtaggtgcgctcgtgagaggtgccggtgtcgtcccgcagcgatgtggacaggatgcggccggacagccaggagtcgtcggtgtagttgttgccgtcgccgtcgtcgaccgtgaccgtcttcgtcgccgacgcgtccgccttggacgtacggtcccccgacaggcctcggtacagccaggacttcttggtcttctggccggcgcccgcgccggtggtgacctggacttcctggtagccgcgccagtcggtccaggactcgtcctcgtccttgatcagtggatcgttggtgaaatgccagccggcgccgtcctcgtaggtgtacgaggttgtcatcaccggcgcgccgtcctggttcgtcgtcactgtcgggtcgacttggacctgggtgaccaggaacttcttgaaccatccggtcttcgagtccgtctcgccttccggggtccacttctgccagtagcagtcctgggtgttggaggcctgagcaggcaggtggtcgatatcgcaggcattggcgaaaccgtaggagaccgtggtggtggcgccgaggtcgccgtggatctccttgatgcgggggaagttcagctcggcggagccgaccttgttgtccaggtcggtgcggttgaagttgatgaccggcaagacgatgtcgtcgccgtcgccgtacgtcttgcgctggatgtagtcgagccagagggtcttgccgatcgtgccgtccgggttgggcatcccgtacttgttctggtattgctgcaccaggtcccagccggtgccgtcctggtcgctgacgtacgtcttgatgtcccacagcatgtccgtggagaagaacgtggggaagtacgtcttgcccgcgcagttgtagtccgccgacgtgccgtcgcacatcaggtcgaccggcacgtcggggtatgagcctggtttgtcgtcgaaggccgggcaggcggcgggctcgtcgcgcagggggtcgttctcctggacccgctcgatgcaccggttaacgtggctgagttcgaccttcgccgggaccttgccgtcggtgatctgcgaggaccagccgtactggatctccttcacatagccggatgagacgtactcgcgggccttgtcggtgttggcgaccgagcggtagtggttgtactccttgtcgtagaagtacatagtctcgacctcgttggcgtcgaccgcccggtccaggttccagcgccaggcctgcgtgcagggctcggggaactggtcgtggcacggctcgcccgcgtcgttgccgacgacggggacggtgaacacggacgcggtcgccgtactggtgcgctccgagcggccccagccgaagtagtagcgctgaccgtcctgggtcgagatcacccagtactcgccgttgcggcccgcgccgtgcccgtcgaacagacgctgcacacgccagcccgggtcgttcttgaggtggtaggcgccgctgccgttgttgtcctggatcagctccgaggtggtgccgttgaggctgatgacgtaggccgctccgtccggctccttagccgagtttggcgagtcccagcacatgtcaccgatcgtgggcaggccgtcctcggtgcagttgcggtaacggcgctcgatgaagccgacgttcagatcccagcccataccggaccaggacgcctgattgttggaagcagaggtacggccgtccaccgactgcgagtcgtacgacatcgccagcgacggcgccgagcccatcggcggcgccggcacctggatcggcacgctgtagttgaacgagcccgaccctgtggacacctcccacgaacccgtcggcgacagtgtcgacgcccggtaatcccccgcgtccgaggacgagctggaggtcaccgcgtacacactggcgctgctggagcccgcctcccgcatcagctgcgctgaagcacccgcggagcccgtgtcggcagccgccgtcacggtagcggtcagggtgccggagtccgtgtcgttgtccaccggcacaaactcgcggtctgcgcagctctcggcatccggcgtctgcagtgcacacgcgggcaccttcaccaacctcagccgggaggcgaagtcagcgccgtaggcgtacttgaagcccgaatagtcgatgtcaacctgcacctgccccggggcatcgacgccatcggtccgggagacctgcagccccaggccgataccgccggccggggccacggcctcgcggtccagaacccgcacctcgacctggtccggagacaccgggtcctggatgggctcatccgaagcggactctgaaggctccggcgagggacttgcctcagccgtagggggcgtgctcggttcggagccgtccgaaacgctcgggcttggggaaggagtgctctcgtcggccagccgggacaaactcagctgggcttcggtgcccagatcctccgcaaccggagcaacttccacaacctcgccgacctgcgtgctctcaccgtcaccgacaccgcccgaagccgacgcggatggttcgggcgacaccgtccccggctctccggcagccgcctccgacagatcgaccgttgcctcggccgcgctcggccacttcggagcggggagcgccttgccgacctcctcagtctgctgcgccgggaccgaccccagagactgcgacggcaccactggcgtcggatcgtcagaagccgcggctgcctgtatcggagacaccaccgataccgtcgacagcaaccccgccagtaccgcacccgcgaaaccgaccgaaacaaggcgcgcacgccgaacagccacccgaactccccccgtgccgcccgcgccgacgcgcgggcggcagcccaacagacaaatcagcagcccccgggtatggcacagccgcgctccctagtgctgggttcctcaaacggtgtacacatatcggcgccgtagtcggcgggttggtggtgcgggtctgccccagatccaggggttggcacgggagttgagctggctggttgcaagggcagtggcgtgttcgatgtcgtcggggttggcgaatgaccggccggcgagggcggctttgcggaagatgcgccaccagccttcctgcaggttgagccagcacgcgccgacagggatgaaggcgtggtggatgcggggatggtcttcgagccaggtccgggtggacaggctgttgtgactggacagattgtcggtgacgatccagagctcgccggtcgggttggcgtcttcgatctgttgcaggaactgctggtagaagacgctgttgcgggaggaagcggtcatggtgatctgctggccgtcccggacgcgtaaggccccgtagacccaggtcttctcgggtccgcggctgtagtcgagttccgctttgatccggtgcccatcgggtgaccaggcgggtgcgggcgggaaggtccgcgggatcactggccccagctcgtcggcgcagatcaccgtcgcgtcgtcgggcgggtgggtgtagaggccgatgatccttgtccttttgggacgaagtccgggtccttcgaccttgtccaggaccgggtgcggcgccagcgcacgccctcggcgagcaggatacggcggacctgtgagcggcccacctcgaccccctcggcccgcgctgccgcggccagagaatccagggtccactcaggtggcccggactcgtcgaaggcccatagctccccgacgggctcccaccgcagccgccccggcggcacggtcttgaccagggagatgatccgcgatcgttcctcctcggtgatccgtcgcttgcggccctgcccgcccagatcatccagcccttgcaggcctgagcggttgaagcggtgcagccagcaccggaccgttttctggctgcagtccagttctccagcgatcgccggcacccgtagtcccgaccagctcagctcgatcatccgggcccgcatcactgcatcgcggggagccttccgtgcccgcgacaatcggcgaacgacggcccgttcgtcctcgtcccgccccggtcgtgcccgtaaaaccatcgtccagcacccgcccccgagcatcgtcaactaccccgccaccaggacatatacccagcgaaagaggaacccagcactagtagggctccgttaggtctgtctcgcggtcctgtttgggggcatgttgaaggtgtggatgcacatgaagtgaaccgtgctcgggcgacgttggcattattcgtggctgacgtgttcgcgtcggtgccgcgtaaggaccagcgggcgaagggcgactgctatctgcgggggctgatgctggacggacggcgtaagtcgatccagccgatggcagagcggctgccggatggcaacgagcagaacctgcagcagttcgtgaaccagtcgacctgggatccggtgccggtgcggcggcggatcgcggagcggatggtggcgcagatcggcccggatgcctgggcggtcgatgacgtgtcgttccccaaggacggcaagatgtcggtcgcggtcgcgcaccagtactgcggggcgctgggcaagcaggccaactgccaggtcgcggtgagcgtgcacgcggtctccgacactgcctcctgcccgctgcagtggcggttgttcgtgccccaggagtgggcgcacgacgcgccacggcggcagaagaccgggataccgccagaggtcgggcaccgggagaagtggcgcctggctctggacatcttcgacgagctggccgggtgggggctggtgccgccggtggtggtggccgacgccggctacgggcagaacgccgacttccgcgacggcctggacggccggggcatcggctatgtcgcggccatccgctcggatgtgaccgtccatccgcacgatgccgagcctttcgcgccgccctggtcgggcaacggccgcaagccccagccccgctaccgcgacaagccgtcctcggtggcggcgctggcgaccggccacgggcggcaggccttcaccgaggtgacctggcgggaaggctcccgcggaccgatgcgctcgcatttcctgtccctgcgggtgcggccggccggggtcaaatcccgacgcctcgcccaggccgccgccacagacgaaaactgctgggacggtgtcctgcccgaggtcacactgctggtcgaatggcccgaaggcgccgaggcgcccaccgactactggctgtccaacctgcccgacacgctctccctcgccgaactggtccgcctggcgaagatccgctggcgcatcgagcacgactaccgcgaactcaagcacggcctcggcctggaccacttcgagggccgctcctggaccggctggcaccaccacgtctccctggtcaccgccgcccacgcgttcctcaccgaacagcgtctggccccaaaagccggtacagcggactcaccctctaccagaccctcgacgccatccaggacctgctgaactgctggagcggcacctgcaccacctgccaccgccccctgcccaaaacatccaccaccagccacaacccaagagccagagcaacctaacggagccctactagtacccgcggagtcgctgccgccggaagtggcaagcgcatcaagtggaacagcacgctcgtccgcgacagcggcaccttcaggatctgcagaagccgggcgccgccgcggccggcgagcagcaccccggccatctgcaccaggtgctgcagcagcgggctgcggcgctgatagcgcaccgtcagcccctccacctgctcggtgaacgtccgccgaccacagcccgggccgtcgcagaacagtcgccgtaccgacagcccgataacgaccggacggccgccgacagcaacatcggccagcgtgcggctatagcgactgtgcacccgcgcggaaccgcggccgcagtccggacacgccaccgtcaactcccgggtgcaggctgcgatacggaccacgccgcccgccgcccacacccgttccacccgcaccgcatcgagatgcggagacacgatccgtacgaggtcatcacactcgccgacaatgccgcgtcctgtgacggagcgtcaccggcgcacggtggcacaccccagcttcacggaaatcttgccagggccacgttcacttgtacgccgacaccgcgctgccaggggctgtgcggatcggcgaagtagaccgggacgccggtctcgatcgtgaactgggcgtgcgccgacaactccttgccccggtcccaggtcagtgatcgccatagttgctcgggcagggtgccgatcgtcgccgcaagcgcatccttcatcgtcaccgcgccgtaaccggccagcggcggcccgttcttggtacggggaacgacgccgtagccgtcctggcggggcaggtggacaagcaccgtgtaccgggtcgtgcgatcgaccagcgtgccaatcgccgatcgctcaagtccgatcaggaggtcgccctcccagtgtcccggtacggcgcggtcgtcggcttcggccggccgttcgctgatcaacacctcgggcgtgacgtgggcccacgccttccgcttggaccgggcacgaggcacccgcagggctctgccggtgcgcaggcaggcaacgagctcacgcttgagcgctccacggccttcgacgaacagggcctggtagatcgcctcatggctgatccgcatggactcatcatcggggaagtcgaccttcagccggttagcgatctgctccggactccacgccatgacccattggcggtcgccgcggtgcggcttgttcctccccttccaccgcgggctctccggacccaggaccgtcccgtccgggcggctgacctggccggacagccttgcctgcacgtagtcccgcagccggtcgttcgcggccagcttcgctgtcttcgggcgccgggccacgaggtcggccttccactgcgcgaccgaagcccggtagtccagccgaccgccacgggtcgcggcgttgcgccgcagctcccgggataccgtcgatggatcgcggccgagacgtcgcgcggtctcccggactccgatgccctgcgctttgaggatcgagatctcttcacgctcgtgaaaggacaggtaccggccggactgcggagcaagatccattggtggcatgccgccaccgtgacagaaccacctgcaacccgccgcctgggatacgccgaccgcagctgccgcctcctcggcgaggccgtcccagtgggtctcgtccacgatgcgggcgcctcggccgactgccctcggatggacggcgagcatcgtctgaccgtcccggtcggcgatggtggagtgcagtgtgacctgggacttcgtcgcccggacctcgaccagctggcgagggcggatcttgcgggcggggaccgagtagaggttcgcgtcgaaggcgaccaggcagtctttgccgacatgccgcagatgccgctgcgtgaccagatacggagttgtcggcagcggccgtagagccgtgtgatcgcgcacggcccggtgcccgatgacctcgccgtgggtgccatggaccttcgctcgccgcagtggcacccaggcggcgaaggccgcgttgatctcctcgatggaggaaaaagcccgcccggcgagcacatggtcccggacgatgccgacctggcgctcgacccgtcctttgccctggggccggtaggcggccagcacgtcgacgtcgaagtcgtaatgccccgcgaaggcgaccgcttccgggtgcagcgggaccgcctcaccgggagcaacgtgccggcgcacgaccgtcttggtgcggtcgtagacgatgctcatcggcaccccgccgaagtgcgcgaacgccagccggtgacagtcgaagaacgtcgccagatcctggccggtggtgaagcagcagaacggatcacgcgaataggccccggtcctgaacgcctgggcagccgaggggatcacggacctccgggagatcaccagcagccacatcaccgccgtcctcgatgggaccgaagccgcccgccggcattcggtccaccccccgctccggtcgctctttcgcgcgctgcgccgcgaacgcaagatcttccgcgaccccgcccgccacatcaccctgaccaccgctccacggctcccggccccgctgccgagcgacaccctcaagggtctcctgacccgcgtcgaggacgcccgaagccagctgatcatcgccctcgtggccatccacgccctcacgcacgaagacctgccgcgcctgctcctggacgacctcgaccgagcccggggacgactgcgcgtccgccgccccggacgcgccgaccactacatctacctcgaagagatcaccaccgccctggccaccgcctggctgcggcagccccatcacagctggccacggaccacgaacccgcacctcctcgtgagccgcatctctgccaccgatcccaccaagccgatgctcagcaccgaggtcaccaagaccgtgttcgaacgcgccggcctccccgcgcgccgactgcgcgaggaccgcatctacgacgaagcccgccatacagccgacccggtccacctgatgcggctgttcggcctgggcaaggccacagccatgaagtacgtcacggccacccacccagacaagcgcccggacccgatcgccccttgaacggtgaggcggacggccccaccccgtcagtgcgcgcttggccggcggcctgaggatggtggctgccgcaggcggccgtgggcgctgtgccgaagcgcgatagttgtcaccagccgccctggcggatcttgacgcgctgggctgtccgctgccggacacggcggcaagggttcgcagtcgcggacggtgctgagctggtaggccgcgctcgcgcagggagcgcaggaactgagtccagaacacctgggtctcgctgtcgccgaccatcattcccagcacctcgcggccgccgtcctcggtgatcccggtggcgatcaccaccgcccgcgacacgatctggtgctcgacacgggctatgcagcaggtcgcgtccaggtacacgtacgggaaccggacatgcttcaaatggcggctgcggaatgcagtgagctgacagtccaggtcctggcagacccgcgagacctcgctcttggaacatcagtccttggcgttcacccgcccgccgtcgaactccataggagcggtcaccggtgggtggatcgaagggggcgccgccactccatgcccaaccggcgatctccaaaatggatacggtgttgctgttatggttctagccgaggaggtgggcgttcagtggcaccagctggtcctatgcgagcggccacggcatcggctcggggcccggggcgtccgcccgtgccgctggagcgcatcgtctccaccgcactgcagatcgtggacgatgaaggggccgacgctctctcgatgcggacgctggcccagcgcctgggctcgggcacggcgacgctgtaccggcatttcgacaaccgggcagcgctggtcgcccatgtcgtggaccgcatgttcggcgccgtggaactgaatggcgacgaactcctcgcgatgggctggcagcaagcgctgcggacggtcgcgcataccatgttcgaggcactggcccggcaccggaacgcggcgcgcctgctggtcgaagagatacccctggggccgaacgccatggcgctgcgggagcactgtgtcgcggcgctgctcgacagcggcttcccgccgcgactggccgcgcacgcgtttgccaccctctcccgctacgtcctcggattcgccatacaggtcaacggtcatggcggcggcgggcaactcgcggacgcacaagtgtccgccgtcttccagagtgtcgatccagccttgttcccggccacggttaccgtcgccgggtcgatgcccgttccgatcgaggacgagttctccttcggactcgaactccttctcagcgggctcgcccacctgcgcgacgacgcctgaccagccaggacgatgcgaacctgagccgcccgcctacggggtcatctcggccggcatggagcgtcgccacagttgctggtgctagagcgcgtgatctcgtgtggtcggcggctcgtcagcggaaggcgaagtgctcggcgtggagatgctggcgggggacgccctggcggtggaggccgcgggtgaggttttcgatcattgaggcggggccgcagaggaagacgtgcgtgtcgggggtgatcggtccggcctcggcctggattctttcggcggtcagacggccgtggctgcggctgaacgtcgggtggagccggaactcggggcggtgtgctgccgctgcggtgagttccgagaggaacggtgcgtcttcggcggtggcggcgcagtagaagaggtcggtttgggccggctccgcaccggggtgggtgagccagccgaggaagggcgcgataccgatgccgcccgcgatccatatctgccggggtccgccgagggtgtggtcgaacatgccgtaaggacccttgagggttgcggggtgtccttcgctcacgtccgtgtagaggccgcgtgtaccgcggcccagggcccggatggtgaggcgtaccgagccgtcggcctgcgttccggcgacgctgaaggggtgttcgtgccagccgccgacccgcaggtagacgaactggcctccggtcacgggaagcgccgtcttgccggtgggcgtgagggtgaggtcgaggatgtcgggtgtcggccgctcgacgcggtggatggtgtagtccgcccggggttccctgtgccgtagcaccagttcgtcgtaggcgtaggcggtcatgccgacggtggccatggtgacgtagatcgccaggaggggcgtggatccgttgatgatgagatcgaggaaccagccgtgcaacagcgccgacaggagcagcaggccggtgaggcggtgcaggaacagccagcgctcgtagggcagtcggaggatgcggccgacctggccgagtgagatgaggacgagcagcagcaggccgatggcggagacggcaccgaggagatggcccatccctaccgacgcggtccggtgggcgtagccgtactggctcccgtcgaaaccggagaaaaagtggaggagcaggtggggggtgagcaggagtatggaccatacggcgtaccgcttgtgctggcggtacatgcggtccaggccgccgaaccactgctccagccacatcaggcgggtggccagcaccagggtgcaggacatcaggtaggcggacaggacgccggcgaactcgccgacgaaatagacagcgctgaggccctcgggcctgagccagtcccaggccaggtagagcatgaccgctccggtcgtgaccgacaggggtccgacgtggcgcttcttcaggcgcgggtccaggggggcgcgcgcgatccggacagcgtagatcgctatcacgatcaggacgggcatcgtctaccccccgggggtcggcactgtggacggaggggcgctggtgaagtcgggcggaccgttcggtcgcggcttgagcgccatcaggcccaggtggccgcggttcctgccactctaatactggctacactgtagccgtttatctgctttcagggcgactgctggcgctgcccatccgtggaggcgtggactcgatcggcagcgcttcaggcgaacaaggccgcgaggtatgacgcgacaagcaccgcgcacacggcggcgggcacgagtttggcaaccgggtcgccctggcgcaggtgcacgaccacagctccggcaagcagcaggagaagcccggcccccgcgaggccgccgagcggcggcacggcgaggccgagcaccacgccggcgactcctgccagttgcagcacgccgatgcggcggtaagcggcgacggagaagccggtctcggcggccagctcacgtgccttcggcaatgcgagtgtgttgagcactccgcttgccccgaagatcagggcgatgaggcaggcgagggtgatggtcaggatcatgagggtacttccagggtgtcggcgtcgtggcggcgttacgaggctgttatgggatgggtcgggcacggtcgagttgccgccgggcgcatcgctcggcgaccagacgggcgatttggtcgatcaggtcggggcttgtcgccgaccgtccattcctgcgcgcagcgtgccccgcccccggcccggagccggggagttcctcctgctcgctggccgtgacgtcggctccgccccgcagatcgcgctcgggatggtgctccagggcgtcgcgcaacagccgtccagcgcgggctggctgatgacgatgcgctcggagaagtcgacgacctcggcgtccggccggtgcggcgtcatcgtgatgacgtgcgccccgcgcagcagggtgcggctcatgcaagggggtaggtgtggctcggctgggacatggtgcgggtctttgcctgcggcgccattgcccgcacggccgcttgtgtggtggtgaggaaatcccgagtggcgatgtgcccgaggtagccgtcgggacggatcagcagcagtgtgtcgccagtcaggccgtaggcactctgcagcgtgttcttggggtcggagaaggcgcggccgccgcccgcggccgatccgacggtcagccgcttcaactgggcgcccgtcgtcggccagtcgaggagttcgaggtcccgggcggcgccggggccgtaggcgatggcggtgaagtgcggtccctggaagaggttgaacaggcgggtctcggcgccgtcggcgccgagcagttgggcgtccggggcgcggtcacccacgtgcagcgtgccggtgcgcatgccgtcgggggcgagcgggccgccgtagtaggtcagggagagctgctgctcgtccttgccgcgcttcatgctggaggggtcgagcttggcgatgccgccccacttctccgtagacaggcccaggaccccggcggcgatcggctgccgctcggcctcgtaggtctccagcaaagccgggtcggctccggcgaggacctggccgagcttccagccgaggttgtagccgtcctgcataccggtgttcagaccctgggcaccggccggcgtgtggacgtgcgcggcgtcgccgacgaggaagacacgtccgcggccgtagtgctccgcgagacggatgttgggccggaacacggacttccagtggatctcgtgcagctggatgtgccggttgcgggtgtgggagtggatccggtcgatgatggcgccgatctcctggggcggcttctcgtcgggcgtgagccggatcatccactggaacatgtcgctgtcggggatggggcaggcgccgatgagcttgccgccgaggccgggccacatgtgccaccggttgcgggccaggccactgaccgaggcgtccacgatcagcacgcggtcggactcgtccgtcgtccccacgaaaccgatgtcgagctgcttgcgcaccgcactggagccgccgtcggcccccacggcgtagcgggcgacgatctcctcgaccccgtccgcgcccaccaccttggcgaccaccgtgtcctcgtcctgcgtcagctcggtcagctccttgccgaactcgacctcgcggccgagctcactgagccgggcgtgcagggcgcggtccgtgcggaactgcgggatcagccaggtgttcgggtacgggacgtccggggttgcctctttgtgggggaacatcttccacggcacaccgatgggtcctgcatggagcccgagcttgggataggtgtctccgccggccagcacgtcgtcgagagcgccgaggtcttcgaggacttcgaggctgcggggctggatgcccttggcgcgcgagccgtcgaaagcgtggggggacctgtcgacgatccggacgtcgaggccgcggcgtacgaggtcgatcgccaaggcggagcccgaggggccggcaccgatgatcagtacgtcgatggcctgcgggttgttcatgagtcgagcctttcggtgcgtgcggacacgaacgggacgagctgatcggcgacgtcgcgaggccgttcatagggggccatatgcccgcatttgttaattacgtgatgtttctggggcttcagcagagcgcgcgctgtgtcgaactgcgtcagcggcgtgacgtcgtcctcgtcgccccacagcagcagcgtcggaatacccagggcccccgtccgccggaagaggtcgtcacggccggtgaaaggcaggtgctgcagcgtgtcgaagaccgcgtacagcgagccctcgaagcggaaggcgtcgaggaccatctcggtcagtttcccgccgagctcggggtcgcggacgttgtgccccaggtgtccttgaagtatctgtcggccgcgccgccgggcgatgaggtcggccagccagtcgttgcgcagcagtcggtggggggaggtcagctgaggtttcgcaagaccggcagggcccacaatggtgagcgtggacagcgatgagcggtactgggcggcgtacgtcatgctgaccagcgcgcccatggaggtgccgaccaggtgcaggggccgcgccgtcaggccgagccggtccgtcagttcggccagctgtcgcgtgaacagcgtctcgtcgtatcgcgcctgtacccggtcggagtagccgcggccgtaggcgctgcaggtcagcgtgcgcagcccgcgggcgtgcagctcgctgacgaggccgtcccagtagaacagcgggatggtcagaccgcccgccatcaggaccacttctccgtcctcgggccccgtcaactcgtagtgggtgacgccgtcggacagctcgatgaaactgccgcgcagcgccttgcgcgagtcggcggtgagcttgcggtcctcgaccgaggcgacgaagtacttcatggaacgggcctccttgccctcagttcgcgggtgtgtcggcgcaggagccgaggaacgtcgcgatcgcgtccgcgacccactccggttcctcctccggcagcagatgtccgccgtgggggtggacgagctcctgggcgccggggatgtcgcgggcgaagtgctggccgtcgatgctcgcgctgcgcagcaccagcgtgggcaccgtgatgcgggggatctgcgcgctgcggtccggctggtcggtgttgcagaagtcgacgaaggccgagcggttaccggggcggctcatgagctgatgggcgcggtccaccatggcgtcgtccacgatctgcgaagacggcccgacgctctcgcgcaggctgcgctcgatggctccgcgcggcatcacccgcctcagcaggggccgcaccagcgggttgcgggtcaggcgcattcccgcgggcaccgtcttctccgggtagccggtggcattgaccagtaccaggccggtcagccgctccggatgatccagcgcaacgttccaggcgatgttgccgcccagggaattaccggccaacgcgtagcacggcacgcccagcgcctccaggaagcccgtcaccgtcgcggcgtacgccggaacgcggtagtcgcggtccgggcgcgggcccgtcagcccgaacgccggcaggtcggaacggatgacatcgaacgactccgacagcagatccgtcgcgcggtcgaagtgctgcagggacgaggcactgccgtgcagcagcacgagagccgggccatgcccagcacgcttgtagtggatccgcaggccgtccaccacgacgaaccgggagtcgggctggggttcagaccaggtactcataatggatacactgttaccgataaggtggacgtgtcaagcggaagccgttgtcgcgggcgcggcgctctgcctcggccgactcctgcgcgacagccctgaacgcgacgacgccgaagtggccgaccaggtcgccgaggatctgctgcggatgttcggccttcccggcaacgaggcccacgagatctgccggcagccactgcccgacctggagaccgcggccgaccggcaaggcgccaccgcttgaagccgagaaccgcgaccatccgaacgaaaggtgcgcagtacatgacactccgacgcgtcctcagcggactgagcgccgcagcaaccctcggcgctgctgcggcgatcagcacacgtcgccgcgctctggcggcagtcccccacgagctgcggcacccagtgctcttccttccgctgaacttcggcaacccggtcactctggccatcgctcgccgcctcgtgcccttggtgggagccgccaccaggcccggcgtccgcgtcgagcggcgcacgctgccggccacgaccgacgacctccccgtcggggtgctcacctaccaggcatcaggccaagcgccgcgcgcagcgctgctttggatccacggcggaggaaccgtcatgggtgccgctcggcaggagaacacctggtgcagccgcgttgccgacgaactcggcgctctggtcgtcagcgtcgactaccgcctcgcacccgaaaatccgtaccccgcagctttggacgattgcttcaggacgctccgctggcttcacgccaacgccgccgccctcggcgtcgatcccgcccgcatcgccgtcggcggcgaaagcgccggaggcggactcgccgccgccgtagtccagcgcgcccacgattcaggagtgccggtccggttccaactcctcctctaccccatgctcgacgaccgcacggctctacgcgtcgaccctcccaacagcgccatctatacgtggaccccggactccaaccgcttcgcctggacctcctacctcggccgcccgccacaggaccgcgacgatcgcccctatattgcggcggcaaggcgtaggaacctcgacgggctgccgcccgcgtggatcggtgtgggcgacatcgacctgttccacgacgaagatgttgactacgcccgacgcctgagcgaggccggcgtcgcctgcgagctgcggctcgaatcaggtatgtaccacggtgctgatgccttgctcgacggcaaagcaccttcaatgaccgctttccgcactgccgccctcgacgctctgcgaactgccctggcaaagccctgaccgccccggacatgccaaaccagcctcggcgaccaggccagctcggtcagtcgcgagcaggaagggcgcggccaacgccttctcggcaccccgtgcgctcgaacacgcgcgccgtcgaaccagtcatcgcatgccgctcgaagctgatcttcgacgaacagcaggtgacagaaaggctgagcactggccacaggtgacaagtagcgtgccctgatggtgacaaccatcgtgcttgaggtccagcggtcacgtccgctggagtggtgtattgacggccactcggtgatctcgttttgaggctatgcggtgagttcggtgggcagttcggtctcgtcggtttctgactcgatcgggtggaggcgggccttggcgaggagctcgcggcccatgtagcggcgggcctcggtccactcgtcgttctgctcggccagcaccgcgccgaccaggcggatcagggcggtgcggtcggggaagatgccgaccacgtcggtgcggcggcggatctccttgttcaggcgttcttgtgggttgttggaccagatctgccgccagatctcacgtgggaacgcggtgaacgccagcaggtcgtgctgagcggcaaccaagtgggcggcggccttgggaaacttggcctccagggcgtccagcacgtggcgcatctgggcctggacggcgtcggtgtcgggctgttcgaagacggtccgcagcagcgtggccacccacggctgggcggacttggggacctggctcagcaaatttcgggcgtaatgcgtgcggcatcgctgccaggatgctccgggcaggacggcgccgatcgcggcgaccagaccggtgtgggcgtcggagacgacgagctggacacctttcaggccgcgggcggtcagggagcgcaggaaggcgagccagccggcgccgtcctcggcggtggcaacgtcgatgccgaggatctcgcggtgcccgtcggcgttgaccccgaccgcgatcagcgcgtggacgttgatgatacggccgccctcgcggaccttctgggtcagggcgtccacccggacgaacgcgtaagggccttggtccaggggccggttgcggaactcggcgacccgctcgtccaggtgcttggccatcgcgctgacctgggacttcgacagctgggtgacgccgagggattcggcgagtttctcgactctgcgagtggagacgccgagcaggtaggcggtggcgaccaccgagatgagggcctgttcggcccgtcggcgtcgttccaggagccagtgcgggaagtagctgccctggcgcagcttggggacggcgagttcgacggtgccggcgcgggtgtcccactcgcgtgggcggtagccgttgcggtggttgacgcgttcgtcgctgacctgcccgtattcggcgttgcagagggcgtcggcctccgcggacatgagcgcgtcggcgaacgtcttgaccatcgcgcgcagcaggtcgggactcgccgcggcgaggttgtcttccgcgagggcatgcaggggcagactgtcgggtgcggtcatcgtgctgatctccttcgaggcttcgacacttcgaagatcagccggtggccgttcatctatgcgggcctcatcccgacgccggagcaaacccccggatcaggtcgaacccgtacaccacttccctggacgcaaccggtaggtgaagaccaggggagggtgcgatggccgtcgctgtcagtgtgctcggggcggggcaggccgccagggcaaggccaacctgatgcgcttccgccggggttggtacgactgtctgtcccgacgggcggatgcgttgttcgagctgaccgacgccctgccggcagccggtccggtcatttccctgccctacctgtcgctcgacgggctgcaccggcgtggtcacggcagcacctatgcggccctggccgacggctgcgtggatgccgaagcggcacgtgcgctgttggccggctcgctgccccgcgtcatgtccggtcttcggggtggacgtgagcgtgtgggtccgcagcgacgcggagtgctcacccggacgcggctactactaccacccctccaggcactcggcgggacagccgatcgtggctggctgggcttactcctggctcgtcggcctggagttgaagacgaactcgtggaccgctccggtcgatgccaggcgcctggtcccgggcgagaacccgaacacggtcgccgcccgccagatccgcggcctgctgcaacagagtcctgaactgtgcctgcaggcaccgctgttcgtgttcgacgacggctatgactccgtccgtccggccctcgagctcaccgccgttccggcccagatccttgtccgggtccggtccgaccggtccttctacgccgacccgccgccccggcgcaggacggctgccggacggccgcgccgccacggcgcgaaattcgcctgccccgaccccaccacctggccggcccccggacgccgtccacacgtgcacggacgagcagtacggagcagtgaccgtgcagatgtggcaccgcctgcacgccaagacccagcagcacgacggccacggcagccgcggccccgccccatcatccccggcaccctggtccggctcaccgtcgaccggctgcccggccggaaccgagcaccgaagaccttgtggctgtggtggacagaaccacccggccatacccccgatccggacctgctctggcgggcctacacccgccgcttcgacgtcgaacacaccttccgcttcgcccgccagactctgaactggaccctgccccggccccgcacccctgagcaggccgacaggtggacctggctggtcatcgccgcctacacccaacttcgcctcgcccgaaccctggtggccgaccaccgactgccctgggagaaaccactgccgccagctcggctcacacccggccgtgtccgccgacgatttcgtcacgttcaagcagtagtgggaacaccagccaacccgccacaaccctgcggacgctccgcaggccgtccaccggcgagggcccgcaccccgccaccccgcagtcaaaacagccgcaagacccgcgactcaccccccgcagggataaaagcgaagcttagacactcccgccgacgggacgcgcgctcgtggttggcagagcggaataaatccaggccgagaggtggttgccgggtcgaagcattcagcctgcaacgttccatggagccaccgtgatacgcatcgaggtcacccagcctgtcaatgactcaactcagccagatcaacaccgtcttgaccgcgacgggctgtgggccggtctgctcagcaaagccgagaacgccgtcccattcgtcgctggcatgacggagtgcactgtgctggaacgcacggacgagagcctggtacgcgaggtggtcgtgcgtggtgagcgaatccgtgaggatgtcgccttccagcaagggcagcgtgtcagttttcaccgtgaggatgaccgcgccacctggatgatccacaacgagatcggtgaggacgaatccggcgccctcaccctgaccttcgccagcgagattctgttccatggccagggtgccgaagtggaacaggacagcgaggccatcgcgggcatgcgcgcgagcacgctccagaccgtacggaacaccctggacgtcatccggcgttcggcagcagctggttccacgggagcagccgcataaacgtagttccatgcttcacgggtgggtcggtcaggtctgtggccagcgtggatgggtcacttcgatgccgaggaggtcgagtagatggacctggacgccgcgggtgattaccacggttggcgggtcggtggcagtgccggtcccgcagccagagttcaccgaggtggcagaggatcatccggccggtcggccgtgcacgccggttgtcgggatacagcccgggcatggtctggtcatggctcagcgcgcgccggacctggcgctcgatcaggcagaacaccagcagggccacgcagatcacctggatgagtgcggcgacgcggccgttgtgctggacgaagaccggggtgacggcgagagggcctttgaagtcgctgttgaaccgccgacttgtatgggggtagcgggacgcggtcgggttggccgctcgtagcgtgccgtaggacgccgggccgggtgactcgtgaaccgtctgccgctcttcggggctggctctcccggggtatgtcgccggtccggtgtccgtccgcggtctgactcaacagaggcgtgtcccggccggttggttccggaagtcggcgtgtcggccgtggatgccctgtcgtccgaccgtgaggaacactgtcccgtgatactgctcggtgttgacccccacaagtccacccacaccgccaccgccgtcgagctggaatcaaaccagcaggtcgggacgatgcggatcgaggcgagcctgacggactaccggcggctgctggcctgggccaagcggtggccgcagcggaagtgggcggtggagaacgccaacggattgggccggcatctcgctcagtggctcatcgcccgcggcgagagcgtcgtcgacgtgcctgccgcggcgaccagtcgggtgcgcgaactctcccgtggcggacggcgcaagaacgaccagatcgacgccgcggccgccgccaccgtcgcctgtttgcagggagacggacgggatgtcgagcccgaggaccacaccacggcgctggctctcctggacgaacggcgtgtgaacctggcccaggcccgggtccgcacggtcaaccaactccacgcgctgctgcgtgatctgctgcccggcggcgccccgacccagctgtccgcggacttggccgccaaactgctgcggtccgtccgtcccgctggcgacgtcgagaccgtccgcaaggacatcgcctgggatctggtcgccgagatccggaaactggacaagcagctcacggacaatgctgcccggatgcagagccttgtggaggcatcgggcagcgcactgatggacaccccgggcatcgggccggtcatggccgcccggctgatcggccgcacccgacaggctcaccgattccccacctcggcggcgttcgcgaactacgccggtgccgccccggtggagatcgccagcgcggacaaggcccgccaccggctctcccgctccggcgaccgtcagctcaactccgtcctccacaccatcgcggttgtgcagatacgcatgccgaactcacccggacacgcgtactaccagcgcaaactctctgagggtaagacggcgaaggaagcgaagcggtgcctgaaacgccgcctggccgaccacgtgtggcgcgtcatgatcgccgacgagcgaaaagccaagtccctccctgcccatgggacttgacaagacacagaggcaccccgggttcggtagagatctcaggttgtggttgtgacctggggtttcgtgagttcggtgtagccgggccagacgcatccacactgcgcacgagggcagcgcggccaggccgaccacgatccaggcgccgctgccgatccagccgggggcaccttgctggagggcggcgaccaggaaggtgccggcgatgatgtacccgatgccctcaaggacgtaactggtcagcagggcggtgaaccagcggtgcgtgcgcggccgttcggccgcagcggtggcggcgggagccgtggccgccgcgccgcgtgggaccagattccaagcggcgacggtcagcagcacggtgagcacggcgcaggcgaaccaggccgtctgccaggagccggcctgctgcaccgccaccaccatcagcccggacagggcgatacccgcgccgaccccgccgaaggcccagccggtcatgtgcgcggcgagcccggccagcatggcactcgtagcgatcatgaagacgagggcgctggccgcgcccgcgatcagccgcagtgcccaccaggcgccgctgtcgtgggtcaggggcatcagagatagggacgcggccaggaccagcagtccggtacgcagggcggccgtcgagcggagcagcgcgggggcggcgatgccgagcagggctatgtggggctggaaggcggtgtggatgaccgggcgcagactcaggccgcgcagggcgaagacggaggcgatggtccaggcgaggacggcgatgccggtggcgacggtgcggccgtcggcgggggaggcggaccacaccatgccgacgcttgccgctccccagaggctgtaggtgatgcgagcgccggtgctgtggaagaagccgccgaccaggccgaacaggccgaccgcctgccagaaggcgtagacggcggatccgctgacggcgaggccgtcggtgtgctgggcgatgtacgtgcggatcggggtgtcgatcactgcccagaagctgttggaggtctcgacgccagctgggtctccggggtcgcggtggcgatccggtgggccacggcggagacgatgtcgtcggcggcgtccagcatgatgatgaacgcgcacacgctggccaggctgagcgccgccttgatccagttggccatcccgtgccagcccgcgaaccgcgcgtgccggacgtcttcccatcgccaagccgacgggttcgcggattctcggggtggaatcgcggggaaccggagggggacgtggcgcccgctggcggagtagccgacgggttggggtgtgagactggtgagctcgcatgttcaggtgtcgcgtattcgcggccgagcccagatggggctcgcgctgattgatctgcgcgagctcggcggcacccggcaatctgctggtcggcgattggcatgatgggcagcggcaagtctcaggtgtctctagaggagcgactatggcgttcgagaccggagtcgccgaacgggaccggggcccttcgtacggtgcggcatcgggattacgcgtcctcccccttcggtgcttcggagcgccgcaatcgtgtcgaacccggccgtcagcaggagcgcggccgcgatgccgtgggagcccgcggcagccgcgatcacccagaggagcagcgggacttcagtccgttcccgggcgattagctcagtgggagagcgctttgttcacgccgaagagctcactgggtcgaacccagtatcgcccatcgggaaagagccggtccgcatgatgcggaccggctctttattgtcggtccgcggccgggatacgcttccgatcttcgtggggctggggaggccccgtgatgtggggggtgtttccttgagtgccgcaaaagacgagagccccagggacatttggaccctggcccgcagacgcaggatcaacgacccgctcgcgatcacctttgtcacgctgttgctcggcggtctcgtcgcgctcggctgggtgagcgggaacgtggagcgcgtcaacaccatgtgggtgggcgccgaggtcgccgcggacggcagtgttcgggtcaccgaggtcatcgactacgacttcgggtaccccgacgcgactcggcacggcgtctaccgcgacgtgccgggtctgtacagcgaccaggagaccgccaaggtcgtcgcgaccatggatggccaccgcgttccgtgggagttcgacgcgggcgactactacgaggagccggacggccgacgggagatcgccacccgcgtcaaggtgggcgaccccgaccgctccgtcaccggcgtgcaccggtaccgcatcgagtacacgctcacggacgtcgtgaagaacggcaaactcgcttgggacgccgtcggcacgggatggcgggtggaccgctccgacgtcgagatccatgtcgtggcgccctacgacctcaccggcacgcgctgcgtgcagggcaccaacgggtcggaggacggatgtacggccaagaaggccgcacccggccacctcgccgtcacgctcgacaagctcaaggggcgtgagggcgtcactctgtacacctcccgtggggcgaagctgaccggcgcgaagcccgccctgcccgcgctgccctccgggaaagccgtcggcgccgccgtcccgcatccgctgtgggtgggcctgctcgccttcctcttcgccctggcctgcgccctggtgacggttcaactgctgcgcttcctcggccgtgaccggatcgccgaggagggcactgacggggcgcccggcaggacccggcgtgtggacctcgaccggcgcgccgcctcgctcaccccgtccctcgtgccccccgagggattgaccccggcccagggcgggatcctcctctccgaaggcgtagggcaccaccacaaggtggcctggctgctgggcgcggccgccgacggccacatcaccgtcgaggggaccgaccagcaccccacgctgagacgccgggatccggccgacgccccggcggacccggtcgcgagagtcgtcttcggcagcatcttctcggggcgcgacacctgcaccctgggctggtacgacccgcagttcaggtcggcctgggagagtctcacccgcgcgctggaacagtggcaggcggacagcggcctgtgggacgcggccgccgcgcgtcgttcccgtctcggacggcccgtcggcctcgccgccaccttgctcggctttgtcgtcgcagggctcggagcctgggtcggcggcggccggaacgcggtcggctggccgatcctcgccgtaggcctgatcgccgtgagtgtcggctacgcgctgcggcggcgctcctgggaacttgagacccgcagccctcgcggcgccgccctctggctccggaccgaggcgttccggcgttacctcgccgacccggccgcgctccaggcggacgagcccctggacgaggaacggatggagctgtacacggcctgggcggtggccctggacgtgggccaggcctgggagaaggcgatcgccgactcgaccaccgtccccgaacaccggtcggccgtgacctcccggattgccccggccctggccgtgggcctgctcctccacaccgcgcgcgccagcaccgccccggcgtccagcagcggcggtggcggaggaggtggaggcggtggtggtggtgacgtcggcggtggctccgggggcggcggcggcggctcctggtgacgtcacccgtgtaacgaaggcgcccgccttcgcagtgctcggcgcgaactcccgctttggcctggtgatggccgcaggcttcgccgccggcgcggtgctgggcgtgctgctcctgggcgtgttctcggacctggtccttttatccccgtgctggcagtgatcctgctcgcctcggcggtcaagttcgcccgtcacgactgacgggggcatggccgccgctcagcgggggcttgatcaatctcagcgtggaggccgccgggtggatccagcccgtcgacaccttgcgagcagccggtcggccggtatcgcaccgtcaccgtggcgctattcaagctcgcggaggtccgagcgctgcaggatcaacctcaaggacgcgcgaggctcagcggaaccagcgtgaatatctgcgtttcaccgtctgtggtcaccgggggcatatcggctccaggttccgccggcttcggtaacgggccgtgcgggcagtctgtcggtcccatttgggtcaccggtcagcacggaacagcgataggtgcgggtagaacctggggggccaggagttcctggacgcgatggcgcggcgcaagcaggtcgatccgacgatggcgttgctggagaccgcgatcaaggcgacggcgaagggcggcatcggcaagctgcgccagcgcagccggggccaggtgccgtactacgaggagtacccggcgctgaagcgggagacgtggcgccccgacatccgggccgccgtgctcgcgaaccagcgcgtgggcctgcaccgcaagctgatgaagacggcggccgccgccgacctctacccgacctccatcggcaccgacgcgatcgtctacccctcgcccggcccgtccccgctggacatcctgccgctcaccaacgaaggcaagcccgtgccgggcacgttccggctcggtgtctcgctgatccgttccgccgtacgcaacgccgacgacaccaccgatgaccgctggagtgagcgcgactggcagcaggctgcgcagcgcgccttcaccgcccttggcgaacagcaccgcaactcccccggctcggtaggctgctgctggttgcctgcctgcgccagggcctgcgcctggcccgcgaccaccgactggacctcggctggctcatcccggcggcctggacctgcgtcagcgactccgtgtgggaaccccctcgccccacccgacaccgacagcacgggactggacacggccgccgacgccctggtcgaactcctcagcgcgctcgcccgccgtcagcaccagcaccgctcgcgcaccgtcgcccgcctcaccacagtcatcaacagccgcctgctccctgacgacctgcagcacatggctctgtactaccgggccaaggcccaccgcgatcttggggacagcccggcctcccgcgcgggcatgcaggccgtcgccgacagccagggccgcctcgcccccgccgcccgacgcggacttgcccatctcgcccgcatggccggcgacttccccaccgccctcaccaccgcccacaccctgggctgggaaggccgccaccaccgcgtccaaggcgacacctggtggccccacggcgacatggaccgcgccgccgccgcgtacgccgccgcacgcgacgaagccgaacaccacggtgtcaccggtgagcgcggcaacagccaggcccaccgcgccttcgccctggccttcaccgacccggccgtcgccgacagcgagctcgccctcgctgagcagcttctggccggtgtggatctacgcgccaccaccctgatcacccatatcgcggcgctcgcccgcgacgccggccgcaccgacgccgacatcgacgaccgcgcccaggtgctgcgcgctgagatccgtacagcgggcgtgacatacaccgagctcgccctggacctcaccctcgccttccaccacgccgtccgcaacgaccaggaccaggtggccacgacgatcgcctggctgcgcgagaacacccgcagcggcgccttcccttactacagcgagatcgccgccttcatggccggcctgcccctgccccaggcctccagcactcggtggatcgacgacgaaccggccacccgccagcgctggcacgccctggtcaccaaccgccgacagcacctccacacccagcgatagcccaaacgcccgcccctgcggcggtgccgctcggtacagatcgggctcggtgtcgcggctgggtagggccgtcatgacgtccggctggtcaggtcaagcagtaacgatgatccaaatagagagaccggctccagccgccggcgatgacgccatggagcgcgatccacaccacgtacagccggatcttccgcaggcgggaaaacgcgcacgctgcttgtcggacgtcgcttgcagggcaggctcaatgccgagatccgggaactgctccgcgaccttcttccgcagccctctcgcctgtccaacgtgaaacgcgcagcgctcatggaacttgaggcaggcgaacactccgtagagcccaagcaccatcatcggaacgagcatggatgggcgaaggccaatcttggcgatgaaacccaaacccgctgtcggcgccttccgtcggccagccgctcaacacgcgcgacggacaccccgtcgaggttgagcagcaacgtcgtatcgttgaccaagcccgtggctcctgcatgatcgttctgcgtcgaaaacagagatgatcaagcaggcccacgggcatcccgcatccggggccgtgccgaatgtctcatgacaatcggccgggtgtggttcgctgctggggtgactcaggacttggagatcgtcgcattcgaatccgccgaggcattccaggcatggctcggccagaaccacgccgtttcacccggcatctggctcaagcttcgcaagaagggccccggtatcgccgcgctggactacacccaggcgctcgacgtggcactctgctacggctggatcgacggccagaaggcaaagttcgacgaccagtggtggctccagcggttcaccccgcgcaagccgcgcagcaagtggtccaaggccaaccgggacaaggtggccgccctgatcgagcagggccggatgcatccgccgggacaggccgaggtggaccgcgccaaggcagacggccgctgggaagcggcctacgacggcgcgaagaccgccacggtgccggacgacctcacggcggccctgaccgccgacccggccgcggcggagttcttcgagacactggaccggcagaaccgctacgcgatcctgtaccggatccaagacgccaagaaggccgagacccgggcgcgccggatcgaaaagtacgtagcgatgctggcgaagggcgagaagctgcacccgtagtcacggagagggaccgtggcctgtgctgccctggactcccggcgcgcctgcggccccggcagcagccaccaaccgccgtcgctgagcgtagagaaaggccagaggccctgagcaggcgcaccgctcaagatcgaagacccaccaattgttatccactggctcgcccgctggcgccttgaactcgcgcttcgatcaccgatcctgtaacgcgctcagttgccatggcggtgcttcctcaggaggagggcggtcccccactccgtcccaaggatctgcggcaccgccaacgtcagcaaatgtctcttgtccgccgcggcgggtgccaaggggcaccgcttctacgactgggccctcatcgacctcgccgaaccgggcccgggccgtcaccagatgctgatccgccgcaaccgcacccccggccaacatgcctactaccgctgtttctcacccgaaccggtgcctttggccgagttggtgcgggttgccggatccagatggcgggtggaggagaccttccagagcgggaaaggggctggccgggctcgatgacaccaggtccgccgctatccctcctgggcccgctgggccacccttgcgatgctcgcccacgccttcctcgtcaccgtccgcgtcgaggaacatgcccgtcggcccgcacccgatgggctgttgccgctgtcctgcaacgagatccagcgcctgttcatcgcactcatcgtccgtcccgtccacgatgcggcccaccccctagtccgactggcggcggcgccatcaagcccgagcccgcgccggccattaccgtcggcaggagaccggtggccgagcacggcaggcgccgttgtcggccactgtgtgattgcagtgccggatggctgctacctgggggacatgacttcgtagaggttccccgcgtcatcggtgaagtacaggccacgagggcacaacgggtggtcgatccgaccgttgtcgggctcgctgggatcgttgccatagggcaccccggcggttcggagccggtcgaggatcgagtcgaaggacgacgggtccacgtcgaaggccaggtgatggccgaccggattctcgacggacatgaagtccagcgtcagagaatcgttgacctgcaccggcgcgaaatgccgatctgcacctcgatagtccagtcccatgacggaggcgaagaagcgtgctgccgcctcgttgtcgacggctggaacgatggtgtggttcagcgtgatggacatgctctgcctctcagttctcgaccggctgggacaggacgccgtgcaggaagacgtggatgaggtcgtgcactcccaactgcgtcgacgaatccgctgactcgcctcctaccggcggcctgccattcccgacgaacagcagacccaggaagatcagtgctgcctgctcgggaggcaaccgcagcgactcccgttcaggttcgaagagttcggccagcgcctctcgtacgggcagggagccggccgcacgatcaggcggcgcctctgagctgctgggacggccacttcgtccccgccctcccgtcgcatgaagcgcaccgaccaccgcgccgacccggtccaagtgggcatgcagcgcagaggcagcctcggtcagccgggcaacgagcggctgctccatggacaccaaagcgagttcatcgagggcatgggccgggctgagagcctccgtcacgcatgcgtccaggagctcctccttgtccgcgaagacgcggaagatcgtgccctccccgatgcctgcggcctgagcgatctggcgcgtcgttaccgcgctgccgtgctcgatcacgaggggaagcgcagcacgaacgatcatttcccggcggctgtcggggtccattgccggcgctcttcgccgacttggtgttgtcgtcatggccacaagataccggagtgagcactcactccggtcaaggggccgccgaacgggagggtgagctgcccgccccggccgccctgtcggacgtctggcgatcacgatctacaactggagctggagctggacatcgtcttgcgcgacaagcacaacggcccgccgcatccggcgtcacgaacttccacgacctgacgtgacgtcagccgagtgccctccgaaacacggctctgaccagcagtgacagcgaactgcgactggggtgctaaccggcggggcggtcgaggacccgttcgactagcgccgtgtcgcagtattcggtcacctcggtaagacgcccgtcggcgacccggaagatgtaacagtacgtctggtggtagggctctccccgtttggtggtggcgtatccgcgggcttggaccacgacgcggtcgccgtcggcaagaatgaggtctgcctcgctacggtattcgccctcgaattgcgccatcagtggtcgcagcagcccgcccaccgcgactgacttgggttcccaactaccggcccatgaccagttccctggaaatatccaccggaagtcctcggccatcgcctcgctcatcgcacgggagtttccccgggccatctggtcgaagatgtcctcgaggagtttcttgttgcgtgcagtatccatgcggatgaggttacctgcggccaggtatgcgtcaaacgccagtcttgcatatgtgctatgactatttcgcatgagtgatttcacggtcgtgggtctgcgcgtggtccgagaggcggctcgctacggctccttctcgatggcggccgagcggctgggctacacgcaatcggccatctctcgccagatcgcgctcatggagcaggcggctggtcaggcactgtttgaacgccgggcccggggcgtacagccgaccgacgccggctggatcgtcgtccggcatgccgacaaggtcctcggtgagctccacgccgcccggcaagatctcgaagatcttggcacgcacccgcctggccgtttgcgtgtcggagcgttctccaccgccatggctgcgttggtgcctcgggctatcgccgccctcatcaggcgggaaccacaggtgcgggtgccgctgcgcgaagggacaactgctgcccttgtgaccgctgttgcccgaggacgactcgatctcgccgtggtgaccccatccgagtccctgcccgagggcgtggaggcgaccctaatactcgacgatccactgttcgtggcggtcgcgccggaacaccccttcgccggccaggcaagcgtcaccaccgcaatgctcagacacgaacggtggatcgccggcagcgccgagccgggctcaaccctcctcggcacgtgggccgattcctcgtggcaaccgaacatcgcgttcgtcgcccgcgactgggtcgccaaacttggtctcgtctccgccgaacttggcatcaccgtcgttcccggcctcgccgtgccggcactaccccctaccatcggcgtcgtacgcatcgaccatcccgccgcggtacgcgccaccgccgtggtacatcgttcgggcatcccagacgaccgccgtcagcgaggcttcaccgagacgctgcgggacgctgcggcccaactgtcggccgaggtccgacaccggccacgcccgggccgcacagctcactgacgatcacgggccttgacccaaggccgggtagttagggcttgccgggaaacaagccgtcgcttccggctctgtggatcgttgttgtggcatggggagtccggaggggatcgaggcggctctggccgcaaagttcgggacgttgttcccgcatctcgacgagcggcagcggcggctggccataggagcagaagcacggtcgctgggccatggaggcatcaggctcgtcgctcgtacggccggagtccgggaggggaccgtgtcgcgcggggtgacggaactggagtccggggaggcgccgttgggtcgggtgcgtcggtccggtgggggccgcaagcgtgcggtggacctggatccgggccttcggcccgcattgctggccttggtggaaccggatgtacgcggggacccgatatcgccgctgcgctggacgacgaagtcgacccggcaactggctgccgagctgacccggcaggggcaccgggtctctgcggacaccgtggcggccgtgctgcgcgaggagggcttcagtctccagggcaacgccaagaccatcgaaggtgcccaacacccggaccgggatgcgcagttccgctatatcaacgaccaggccaaggacttccaggccgccggagacccggtgatcagcgtggacaccaagaagaaggagttggtcggcaactacaagaacgccggccacgagtggtgccgcgaaggtgatccggtccgggttcgcacccacgactttcccgatgccgatctgggcaaggcgatcccctacgggatctacgatctggccgcggacgcgggctgggtcaacgtcggcaccgaccatgacacggcagccttcgccgtcgcctccgtccgccgctggtggcacgcggttgggcgcgacacctacccgcgctcgcaccgactgctgatcactgcggacgcgggcggttccaacggctaccgcacccgggcctggaagttcgagctggccgcgctggctgtcgagaccggcctggagatcactgtgtgtcactttcctccgggcacatctaagtggaaccgaatcgagcaccgactgttctcccacatcacgatgaactggcggggcaggccgctgaccagccatgaagtcatcgtgaacagcatcgcagcgaccaccacccgcacgggactgacagtccgcgccgtactcgacaccgccgtctacgagaccggcgtccgcatcagtgacggacagctgaacgccctgccactgagccgccacgactagcacggcgactggaactacaccgttcacccacaagaacaccgccgggacggcgtccttcctattccaccccagaacgaagccggctccggccgcgactggctgacccatcccgctctcaccggcatcccgcacgagcagtgggactggttggtcaccgagttggcagcagcccgcgcggctcagcgggaagcagacctccatcagcgacgcggcggcgaccggcagaagacccccgccgtcggcctctacaccggccgacgccccggcctcaccctcgtagaccggctcctggccaccatcctctaccagaggttcaagctgccccaggtcgtcatcgccccgctcttcaccgtgacacccgtgaccctcaacccggccatcagtcaaactcgccgactcctccacgacatcggacacgccatcgaacccgccgagacaccactggccaccctcgacgacctcatcgacctcgccacacacctcggcatccccgcgccagagatcaagacagcgagttattgatcggcaagcccttagcgtatttccgctgatggcaagagggttgagcgagttctcgggctgctgtagctggcggggccggtcttggtgatgagtccgtttacggcccatctgtcgagctgtcggtacatcgtgctgagggtgatgtcgccgaggtggcgggcgaggtcgcgagtgtgccactggcggtcgggttctgcgtgaaggaggtccaggacgcgctgtctgcgccggtcggcggccggtgtgtgtcgatcgtcgtgcgagacggtgggcaggtcgggatcgggttcgaggatggtgacgtcaaggtcggtgaccaggcggcttttgtcggggcggccgtcgtcttggcgttcggcgtaccgggagaccgatgacctgacttttcgggtgctgatgcgggggcgccggtgcgggaggagcccggccaggacccggttgccgatgacgcggtggtgcgggtgcccagggcgccgggcttgatgacgtcggcggcctggaccacgaggtcgcgggcagtgtggatggctatggtgaagccgcagcggtccgggtcggtgcccggccgggactcggcggcctccaccatcacggtccgaagtgcctggtagagggcgagcagggcccacatctcctgctcgaccccgaccgggtcgcctgaacgcaggacccggccgtctgtgatcgtgtgacgcagagcaaaatacgccgactcgtgctcccaccgctggtggtaaagggcaacgagggccggggcggggtaacgacgagcatcggtcagcgtcgtgaccagccgataggagttggtgaacgagcagtcgtcatagatcacggtgatctgcgcttccacgacgcgtaccgggacggtgccgatgaccgagaggtaggagccatcggtgagtcggctcaggaccggggtgcgtcggttggcgcgcagccggcccaggaacctggctccggtgtcgtgcacggcggcgaggaaggcgttggcgtcgaaacccttgtcccacaggaccagccagcatgccggggcccaggtggtgcaggagcctgcgagcgtaggaggtctccccgtcgctgggagtgccgaacacggcaccgatcagggcacgggtgccggtctccaccagggtcatcagttccagcatcggatacccgccacggctgccaggtccgaaccactccacgttgcgctcggtatcggggagcttgatcgagctgcagccgtcgaaggaggccatccggaacggcccgaaccgcactccgggagtcaccggctgggcgagcgggccggccagggtctcgaacacgcgcttcatcggttctgcaccgagccgtctgcgcaggtcacgcaatgctttcgcagttggctccgcgacctcgaacccgacgcccgtaagggctgcggtcagcttgtgccagaccagccggtagccgacctccgggaacaggcacatcgcgagaaggaagtagaccccgacccgcgagggcagatcccgtaaccggcgctgcacgcaacgggtttcatccagaacggcatcgacgaggtcgaacggtatgacctgcgtcaactcgcccagatgaccgggcgcgaaccggccctcagccacggtgaactgacgggtgaccctcgccagaccgggtggcagcgcacaattacgcgtgggcaacggggctcctcaacggccggaagtcttggcggactacctgaccaacgcggccccgttgcccgcgttcctacccgacaccgaattcccttgccaccagcggaaatacgctactgacttcggcgtttttgggtcagttcggtctgtcgagagcgaggcctgtcccggcgaggaacccgtcgaggatgccgtgcaggtactgcagtgccttgagccgcctgcggagcagagtctccagctcgttgagggtgcgggcggccaggttggccaggctccgcttgatatgcgcccacaggtcctcgacggggttgagctcaggcgcatacccgggcaacaggaccactgtcagccagtcccggccggccacgagcgccttcatcgtcttggagatgtgggtgttcagccggtcccacaccacgatcagcggggccttgagcaggtggtgggcgccgtcgagcaggtggatgtagtcgctctcgccgagcgagcgccgctcgcccttgcggccggtgtgccggcgcagccggtagcacaggcgggcgggcaaggcgggccggtagcacagcagcccggccaccgagagccgtccccggctgcgaccgggcactttgaccctcggggtgatgccgcgtcggccccaggtgcggcccttgggcggccggccggttacgcccgcttcgtcctcgaagcagatgaacgcgccggtcgccgccctgagcttcccccgagatgcggagtgaattgacagagggtcagatgggactcatgagaggaacatcgaccatggctgctccccgaaagtactccaagaccacggagttaaggccgatccgcggttgtcaaatggggcgggaccgaggggtggtggaggtcgggtgtgatccactcgggttcgagggtgtagatgcctcgcccggtgcggcgaaggattccttcgcggacccagcgccccagttccgcgcgtagtcctcgagcgtcgtccagtccgataccgcgggcgatttcgcatgcgcgccaggtgcggagagggttggtgcgcaggagttgcagcgtgtggtcgcgacgcccgtcagagccggtgccggcggacgagtgcacggtgacggcgatgctggtgatcctggaggccccgaaggcttgggcctggtcgggcggggcggcgtagcgggagatcgggcacttgacgcggcgcgggttgacgcgggcctggcggggtgggagtagatcgtgcagcagggccgatgtgatgcgccctggtccggcgtctggcagcacattggccgcggtgatgagctgttccttggcggtctccagggcgacggtgaaggaagccctgtccggatccgtgccgggaagcgtctcgacggcctcgaccatcgcccggcgcagtgcctggtagacggtcagatgagcccatagctcctgctggatcccggccacgtcctgggagcgcagcaccaggccgcactgcaaagtgtggcggagcgagtagaacgccgattcgatctcccatcgctcgtggtagagctccaccagctcgacggcggggtagcggcggtgatcggtcagcgtggtggccagccggtagtggccttccagccgcagccctttggcggtcgtcaccgcgatgtgcgcgtcgatgaccctcagccgggtcccgttgatcctggtcaggaacgacccgtccggcagtagcgcccagcgggcgggggtccgggttcccttgagccgcaccagcagctgtgcgccggtggccgcagccttcgcgaggaagtcgtcggagtcgaagccccggtcgttgagcagcagcatgccgccgtccagcagcggtagcagttgctcggcgtagccggtctccttctctggcgtcggtccgaagaccgcgccgagcagggcccgagtcccggtctcgcacagcaccatgatcttcagcattgggtatccgtcggtgccgtagcggtgcttgtgcttgcccagccacgcacagactcgcggccggtcaggggccttggtggagctgcacccgtcgaaggcgaccgtgcgccagcaccggtatcgcaccccgggtgtgatcggctgtgccacagggccggccagcgtttcgaacagcaaccgaagcggcgcgacgcccagcctccggcgaacctcccgcaacgccttctccgaagggcgccggtgaagaatcccgcgcagcccggcggtgagcttgtcccacacgcgcacgtaccccagctgcgggaagagggccagtgccagcacgaagtacacgcccaccctcgacggcagcagccgcagcctgtgctgggcgccgccggcgcgttccagcacgtcatcgacgagttcgaagggtaactgctgggtcagctcgccaagatgccccggagcgaagatgccgtcggcgacggtgatggacgacgtgagcgtgacggtggaacactgaacgggcaacggggctccttcgagtgggaagaccttggtcggcttcctcgctctaccaggagccccgttgccatgacctgcgcttccccgaaaatcccggatcccgttgacaaccccggatcggccttaactccgtggtcttgaaagtactcgctggagttgcgtgagcgtgcggtgcggatgtaccgcaccgcggacccgaagccccagatcaagaagctcgccgtcgacctcggcgtccaccccgaggccctgcgcggatggatccgccaggccgaggccgatgccggcgagcgtgacgaccggctcaccaccgacgaacgcgccgagctcgccgcgctgcgcaaggagaacgcccagctcaagcgggcgaacgaggtactgcggacagcctcggcttttttcgcggcccagctcgacccgacccggcccaggtgaccgcgctcctcgacgagcacccgcacctgggggtcgagtgcgtacttcgggaactgcacctcgcctcctccacgtactaccgctggcgccacgcagagcgcgagccgtgcgaacgtcggcgccgggacgcggaactcaccgagcagatcaagcagatccacacggactccggcgggatctacggctcaccgcgcgtgcacgccgtcttgaagcgtgagggtgtgcacgtgggccgcaaacgggtcgagcgccttatgcgcgaggccgacatcgcgggcatcagcccgcgccgaaagggcttcacgcgccgggatcccaaggccacgctcgccccggacctggtcgagcgcgacttcaccgcacccgccccgaaccggctgtgggtcaccgacctcacgatgatctcgaccggtgagggacccttgtggctctcggcgatccgggacgcgttctcccggagagtggtggcctgggagacctccgcccgcgcggacgcggacctggtcctcaccacactggagtacgccctggccagccgagaggtcgagcccggacaactcgtgcaccatgccgatcacggctgtcagtacacatccgtgaagctgacaactcgccttgtgagagcgggagttgaggcatctatgggctcggtcggggattcgtacgataacgccctcgcggagaacctttggatgctcatcaaaaccgagtgcatccgtgggcgcaccttcaccacccgcgccgaggccaacctcgcgctcttcgagtacatcgacggcttctataactcccggcgcatccagaagcggctcggctacctcagccccgtcgagttcgaggagaagcactacgccgaccaggcaacggccgaacgaacgaacctgaaaccccgtcaacccgccctggccagctgatcagcacctcccgcacaccgggggaagctcacccggagggttttacctcctgccaggtcgcctcccgccatgcggtgatcgcgtcctcgttgcgttcggcggcgggccgggcgggcatctgcacgctgaagcccatgcggtgcagcagccgggtcaccccggagatgctgtaggagaggtggaacttccgcccgatcagcgtgcggactcttgcggcggtccacacctggtcatccctccagccgtgcgcggccggcccctcgtcgagccacgtcgcgagcttggcctgcaggtgggggccgagtcggcagtcgtagcccgggggtccctgggaacgcagtgcttcgcgcccgttcaacgcccacgcacggcgccactggtagaccgacttctcgctcacccgtaactcccgggcgatgcacgggacttttacgtccccctcgaagaggtcagcggcccgcatgcgtacctcttcgcggcgtttgcgctgctcggcggtcagcccgcccccgtccggataccgcatacttccgggctaccagccaagacgggccctgtcaccaggtctgacgagaccagacgctataacgccaaggtcagtaagcgtcgcaccggtgaggctcgtccccgcgagattcgcccccataagatctgccttctctagatgaatgagtccaaggggtgttgttgcggtcagtgatcgtaggctgtgagtgatcgtttgatgggctgtccagtttggtcgttgtgccagatcgccgctgtgagtgcgaggatccggcacaagacccgggctgacactcctgcagggctcttgccgccgtgtcgttccaggttgagctgccccttgaaggtctgattgatcgactcgatgacctgccgcagcggtttgaacaggtgtgacccggtcggctcggcttcccccttgcgggctggccgcagcaacttcaggtgacgctcggcaaggccgcgctcgaactcgcggccgaagtagttcttgtccccgatgatcgtctgcccggggtgagcggcgaggacgtctggcgcggtatcgagcatgtcgcgcagtgtttcgcgctcgtccgccccggtgagtgcgaacaggaccggcagcccgccgagtgtgcacaccaggtgcagacgcagcccccagaagtatcgcgagtgtgatgcgcagtagccgtactgggcccagcctgccaggtccgagcgtttggccgtctcacgggagcaaccgcagccgaccggtgtggagtcgaccagccacacatcgtcgctccacagtgaggtatcgcgggccacgatccggatcatgctggtgagcagtgagaacgcggcgcgcagccgcttgttgtagccggactgctggggcacgtagggaaacaggtggccgaagtcccgcccgacgcggcgaagccagcgccgctcagaggtgtatccgagcagcgccgacatgaccgcgagcgtgatcagctcggcgtcactgagtgtgggcgtgattccgatggcaggccgccacggcgccagccacggtgaagccttcaactcgtcgtcaatccgggcatagagtgccgttgcgagggtgtccaggttgttagtcacacatcgacgttggacgccctcgcctcatgtccgcaggtgatcctctggactcattcagggatccggggcgtgcccactgcggtgactatgcgtcacggctatttcgcagggcctggatgagccaggggtacaccgggatcaggttcggtactacgtgccagccgttgacgatccataccagctgccagtatcggtctacccggggatcgtgcgtctcttcgaactgctgggccatccagtcccggaattccgtgtcaggggtgcgcgcgagcacctcggcgaagcggtgcacgaggtcgtcgatgacgggtgcgcccctgtcgttgagcgggtcgatgcccgcctccatggcctcggccaccttctgacgggtgaactccatcagttcctcgccggcatcgcattcgatgtcgagcgggcgcccggccgcctgacgtacggccgtccggcgcatccgggcacggaaatcctcgtcgccgaccagctcggcgagctccacccacgcggtgacctgctcgccggtcggatcatcggggaggtcgggagtggcagcgcgaaccatggccaccgcggctgggtcggcatccactgtgccgaaggtgccatccatgaaatcgtcgatcagacggcggcgttcctcgccggacaactgcgtgagcctgtgcatgagcttggtctcctcgggactggacccgcggctggccacgactcgcagaacactccgacgcagttgcagcgtccggatctggacgtccatggcgtcggcgtgcgccgcggcgacttccgccaccgagagctcacggtccagtacccgttgaatcgtggccaggtccatgcccagctcgcgcagtgtgcgcaggagttccagacggagcagtgcgtcgaggtcgtagagccggtaaccggcgggactacgggtggtcggcgctaccacccccgaatcggagtagaaccggatggtcctcacagacaagccggtccgccgggaaagctccccgatcgagtagagggtcgtaacgtccatgtcccccactctgctgtctccagtcagtggagactcaaggccattccccagccgggccccgacccagacgtccaccgagtcgctgaggcatgcatcgcgtgctctccgctgaccgccaaaatgaaacgggcacgccttgcacgtgctgggcggacgatggcagcgacatgcgacaccactcgctggcggtttacggctacgagcccttggactcaatcatctagtagggctccgttaggtctgtctcgcggtcctgtttgggggcatgttgaaggtgtggatgcacatgaagtgaaccgtgctcgggcgacgttggcattattcgtggctgacgtgttcgcgtcggtgccgcgtaaggaccagcgggcgaagggcgactgctatctgcgggggctgatgctggacggacggcgtaagtcgatccagccgatggcagagcggctgccggatggcaacgagcagaacctgcagcagttcgtgaaccagtcgacctgggatccggtgccggtgcggcggcggatcgcggagcggatggtggcgcagatcggcccggatgcctgggcggtcgatgacgtgtcgttccccaaggacggcaagatgtcggtcgcggtcgcgcaccagtactgcggggcgctgggcaagcaggccaactgccaggtcgcggtgagcgtgcacgcggtctccgacactgcctcctgcccgctgcagtggcggttgttcgtgccccaggagtgggcgcacgacgcgccacggcggcagaagaccgggataccgccagaggtcgggcaccgggagaagtggcgcctggctctggacatcttcgacgagctggccgggtgggggctggtgccgccggtggtggtggccgacgccggctacgggcagaacgccgacttccgcgacggcctggacggccggggcatcggctatgtcgcggccatccgctcggatgtgaccgtccatccgcacgatgccgagcctttcgcgccgccctggtcgggcaacggccgcaagccccagccccgctaccgcgacaagccgtcctcggtggcggcgctggcgaccggccacgggcggcaggccttcaccgaggtgacctggcgggaaggctcccgcggaccgatgcgctcgcatttcctgtccctgcgggtgcggccggccggggtcaaatcccgacgcctcgcccaggccgccgccacagacgaaaactgctgggacggtgtcctgcccgaggtcacactgctggtcgaatggcccgaaggcgccgaggcgcccaccgactactggctgtccaacctgcccgacacgctctccctcgccgaactggtccgcctggcgaagatccgctggcgcatcgagcacgactaccgcgaactcaagcacggcctcggcctggaccacttcgagggccgctcctggaccggctggcaccaccacgtctccctggtcaccgccgcccacgcgttcctcaccgaacagcgtctggccccaaaagccggtacagcggactcaccctctaccagaccctcgacgccatccaggacctgctgaactgctggagcggcacctgcaccacctgccaccgccccctgcccaaaacatccaccaccagccacaacccaagagccagagcaacctaacggagccctactaggggctgcgcgagcagatccctcaagagtgctgcgggatgaagggggtggcggcggagcgagcccgctcccacatgccgggcagctgctcctcaggacgctgctgctcaccgtgcagggcgttgagcaccaccaggcatccggtcagggccggtaccgcccactgcgcgaaggccagctgccgctgggccgagtcgatgtcgatcggatgccgggcagcctctttggcgtcctgcgggtcggaggaagcagccagctcgactttcttgcccaggacacggccgtaggcagtggcggccagggccgcagcggtgaccagggtcttggccgtggtagaggcccccacgcccttctgggcggcgacccggtgagcgttcaccgcaagcagtccgccgccgccgaacaggtgcgcgccaatggccgcggcgttgaccggcgtccacttcgcccaccccgacgaggcgatccgtgccctggcccgggccgtctcgctttggtcctttgctgctccgttgagaccgaccgcgcccatgagagagccgccgaaccaggctgccagacccacatcgtgcaggctgcggatgagggtattgcgatcggacatgacagtgctcctcggaacaggggacaggtgccgacagaaacgtcgagccccaccccaccctcgccggagcctggccccgccgccatcacgactgacccggacggatgcaaggccccggagggagcgtcagggcagtttggttgcgaaacgcggctaccgagaaacagcgctgtcctccaggatcacgtgacactctcgggcagggatgggcgccgccgggacggctggttctggccccaggatgtgcttctcggccacttccaggacgcacgttcgttcgtggccgacggcggctttcgcgccggacagctcccctgccttgcagtcgttgcggttgcccggaacacccgcccagaatcatcgcccgggagtggtccgtcccgtccttgacggtcgtgaggcgtcggtgaggtcggcgccggtggcggcgtcacgctgggagtggttggtgccgtgccagtccaggcacatgacggtcgcgtcgtcctgcagatggccgtcgttggcgtcgacgatcgccgcgatgagggtgcgggcggcctcgcggggatgcagcgcgcgggtgcggatgatcaggtcggacagatcgaggctgcctgcgttgcgctccagcatgccgtcggtcagcatcaccagccggtcgcccggccgcaggtccagcgactggacctggtagctgtgcggggcgtggaagccgaacggcatatcgatcttcggagtgatctcccgcacctgtcggttccgcatccgcagcggccaggggtgcccggcgttgatgaactcggttgtgccgtcgatcaggctgatgcgcaggagctggccggtgacgtagcccttgtggccgtgctcgcgcatggcctggtcggcctggcgggcctgttcggcgaggtcggcaccggcccgccgtgcccggcgcaaggcgcccaccgcaagggtggccagcagtgcggcgtcgacatcgtgacccatggcatcggtgacggagagctggaccgtgtcgcggtcgatcacgtagtcgaaggtgtcaccgccgacgtggtcggccggctccagcgccccggccaccgcgaactgtgccgcctcgcacgccagcgaagccgggagcagccggtgctggatctccgcggccaggctcagcggggtggtgcggcggccccactggtacacgtcggtgaaggaccggttcgcgatgacgatgtacgccagggcgtgcgcggtctcgccgatctcccgcatcacctccgcgtccggtgccgcgggcaggaacagttcgaggagcccgatggcgtccccgcggttggtcaccggggcgacgatccgcaccagcgcgccctggcccttggcctccacgctcggccgctgggtgcggatcacgtcgtcgtacagggtgccccgcagcgtgatgcgttgggcgggttcatcggtctcgacgctgcccgccgcccccagtcgtacgaccgagccgccggtgaagtcggtgatcaggaacgacaccgacgcggcccccaggtgctccttgagcatgcgcgcgaccacgtcgagcgactccacgggcgccgctgcctccgccgccgccagcgtccccgcgagagtcatcgccctgccccggccactcccgctcccgctcccgctccggggaagacgagcggaccgcccgccgtccggctctcttgcggtcacatcggctcctcactgctcgatgacgctcaggactcggcccgggatgctgcgaaagagcttgccgagcccggtaccggacaggccacattgcaccacgggaccccgggcacgccgcggttaccagcctctctcggaccctgcgcggccaggggtccgcccccgagtcctgcgcttcggcatgctccggacgcggttatgtggctgccaggaggatggccgtgtagtgcgcggtgaaggcggcgatggtcagggcgtggaagacctcgtgaaagccgaaccaggccggcaaggggtcggggcgcttgaggccgtagacgacggcgcccgcggtgtagagcagacctccggcgatgaccagtgcgacgaccgcggtgccgccggtgcgtgcgaagtcgggcaggtagaagacggccacccagcccaggacgatgtagcacggggtgtacagccatcggggagccccgatccacagcacgcggaaggcgatgccggccaaggcgcccgcccacaccacggccaacagcaccaactgctcgcctccgggcagcagcagtaccgccagcggggtgtacgtgccggcgatgatgaggaagatgttcgcgtggtccatccgccgcaggaccgcctccccgcgcgcaccccacgtcccgcggtgatagaccgcgctggtaccgaacagcaggcaggccgacaacgcgtacaccgagcacgccgccaccgccgcagccgaacgcgaaacggcgatcagcacaatgccgccgaccagcgcgagggggaacacgccggcgtgcagccagccgcgcagcctcggcttcagcgcagccgtcgcccgctccaccccgccttccaggccggcggctggctgccgggcagcgagctggccggtagcgctggcaggcgcatcaaccacgggggtggacagggcgtcggtggtgtcggggcggggctggaactcccgtccgtgtgcgggcggctgagtatcttcggcgatcatgcgctcatattctggaatcggtggaagggtgcggtgcgtcgccgtgcactgcgggtcagacgccggccgtgtgccgggctgcggcgcggcgctgttcgctgttgatgcgctgggcttcttcgagctggtcttcgaggatgacgatgcggcaggcggcctcgatgggggtgccttggtcgacgagttcccgggcgcgggcggcgatgcgcagctggtagcgggagtagcggcggtggccgcctggggagcggagcggggtgatgaggcgggcttcgccgatggcgcggaggaagccctgggtggtgccgagtagttcggcggcccggcccatggtgtaggcggggtagtcgtcgtcgtcgagtcggttgtgcgggttgtctgctgtcattgcacctctctgtggaacgcatggaggggccctggtgccgtactggcaccagggccccgaaggaactgctacaccatctgccggccctggtactgcgccggcctcctgtttccgctgacccgaccgagttgctgtcgggggcgcggggatcgcggttgcttgaccggagaccacctcactatcgatgtcctgcggtacccgggctcaagatgtcggcccgggcgatcctgatggcgtctggctcctccgttcttccctcattgatcaactacctatcgagcgggtactgcgtactgctggtgatgcgaactgctcagcggcctgttacagcgccgctcttcggcagccagccccgtcgcccgtcttgcgtctgctctggcttagaaccccactgccgaacctcccggtgcgcgcgtccgcagccgacgccttcaccgaggtgctgctcactgacttcactgctgagtaccgcgaactgcacttacgggtactgccaccgcgtcaaacgcggtactgctcacggcggcccctgatcactgcgggccacccggtccggtcgtcagtcccgtcgccgtcctgcaacaaccctggcttcgacactccaccaccgcaccgtcccgcgaactacaactacgtgcgcttgcccggcagttcatctctgccaggccctgcggtctctcttgactacgagagaaaccataaccacgccaccacccaatgtctactccggccaacatagatttccgcgtgtccggcggtgaggtaatcgacctcgagcagcgatggagggtgtcccacacgacgacttcctcggcgcgggcgttgatacgcagttccagtaggacggggccgggggcgtacttgcgggcgttggtgaccagctcgctgaccactcagttgggttatgtccctcgcacgagcggatacggacaggtgatggccggcgtgggcctggtcgaggaaggcgacggcgtggtggcgggcttcggcgacgcagccgtcgtctcctcccagggcgtagccggcgcgcatcaagtattcatccggtgccgtacagccgtcaccggcggcatgggatcccacgtgttagccctcactcccccgtgcgcgtcagtacccgcgatcgcgtcatgcatgccaccagggatgtcgtccgacacggcggaacgcggcgagcttgtccaggaggccgggcagcacccagtagtagacccaggtgccgcggcgctcacagtcgatcaggccgacctggcgcagcagcttgaggtggtgggagatcgtcggctgtgacaagtcgaaggcagggggcagctcgcacacgcagacctccccgatctccctgctatagcgggcgccggccaccagcacgcagtgaggcctggtccgccaccacggggggagcgacggaccaggcctgaagtccacggtgccacacccgtccccgaacgcgcgcgctctgcggatgaagtcgccgcaggatggcgcgtcttcgttcgagcggtcgagttacgcgtgggcccgcagcagggcgagcacggcggccgcgtacgcgcgggatcggtcccagacggcgaagtagtcggtgtgcatctgaccggcctcctccatccgggagggctggatgcgtatgccgtcgccgcggccgagtgcaaggttggtgcggcggctcgtctccgggctcaggccgcggatcggcggtaccggctcgccgccctcgcgcgtgccgtcggggtgaaaagcctcgtacaggtcgtcgcgccctcggtaacccacacggctggcctgcagcagccgtgcctgcttggcgacctcctgcaccaacgggtcattagggctgccgagccggagctccggcccgggggacgggatcgcccgccagatgcccgcgtacgtggaatcgatgctgctgatccaccactggggcgcataaccgccgggcaatacgagcggccgcggcaaccgtcggggtaggcgctgtccgttggcgcgccgggcaagcagtgtgtgtgccgaacgcagcagggcagcgtcgtgcgccttcatcagggccacggcgacgctgatggcgtgggccgccgccttgtgctcgggggtctgtacgtgcgcgcgcagccggcgctggtactcggcgcgttcaaggccggtgctgctcgggctctggcgagccgcggtcgccttcgcctctttcacacgccggtcggccgcctgggctgcgccgagttgctgcgcaagccgttcgacggctcccggccactggccccccaccatgctcacgatctccctccccgctgacgcccggccgctccccggtccaggctatcggcccgtcgtcccgcacccggcgtcaccgcggggcggcccaggcttctcagagccagcaggctcgggacggcccgacaacagctccagcgcaaacgccggggcacacccagcgggcggccggcgccatggcggtcgtcagacagcgccagggaatggtgggcaggaccgcccgctgccatctgccgaaccgcgccggactgcccgcgagtcctacctgaatggtgggggccacggtggggggttggtcgggacggatcaggctgcgcagaatctcggactggtcggcggctcggctggtgctgcggcggactcagttccggctcccagggtgcggtgaccagccgaacgggcggcggcgggtgcgtcgtcgggcggccggggagggccgcgtcccttcggcggcgaggcgggcacgtggtgtaggcggcgagccgactcggggcggtccggtgcccagcgggcggcggtggtcggtcattggccgattctttcccgggcgttcccagcggggcacgggcacttcgggccccggcaccgggccggcactgtccgatggaccttcacagtcgaggacgccgcgccgcagcgtcggttccgcatcaccgcccgagtctgtagctggatcacagtcggcggtagatgccctgtcagacctgagttgcggacctaaccccgccgcgttccaccatggcgccgcccaaagcgcgcgggttcacaaattgttgcggaacctgttccgggccctgcggcaggaacgcgtgatcttccgggaccccacccgcggcctgatcttcggaggcatccctcggcgagctgtccggcgatcagcaacgaggacgtctttgtctttccggcgactccgcgtgacagcgggttttcgcgccccctattcagagatcggcccatgccagctgtacgccgccccatcccccgccacggtcaccgcggctacctcgcctgcaatagctgccgactgagggactactctccgccggtccgcaccagtgcgccgccgaccccaggcgtgtaaacacgacgcgcattcttctcgatctcgcgcctgacctcctcgccgaggtcgacaccctgcatctcggcaattgcgaccaggtacaggaagacgtcggcgagctcttccccatgatcgggcaggcctttgcgccaggccgtgaacgcctcgccgacctcggcgttgagcaggccgaactcaagtgggatgtcggtcgtattgaagccctggttaatcttgttctcccaggcaagcttctgggcgtcggcgatgtccacggcagttccccttgacggtgcggtccggtctctcggggaacactagcgaggctcaagagcctggcgggtgggaacggcacgggagtcagcctgtggtgcgacccgcgttcgatgcggtgtcgtaggtgagaacgggtgccgtggctggccagcgactagaaagctcgctggtaggcgtcggcgagcgcggtgatctcctccggtgagggtgcctgcccgtcgcgctcggtgaccagttcggcaaggtcgaggacctggctctaggcgaggcgcgagtggccgcggtagagggggccgtagacgagttcgctcaggaagctgcggtccagaacaagccggcccggccgggcgaggagctcgcggtagcggctgaccaggtcctggtggtcgggggtacgcggggagtgcacggagatgaagccgtgctgggcgacaaggagcttggccagggtgctcttgccgacgccgtcgccgccttcgatcacgacggtgcggtgtccggtgatctcctcgatggtcaggggccgatccacgcggtcacctcttccgcgctgcgaagcgtatggcccacgccgtactggatcatcaggttgcggtggttgggctcgcggccggaggcgtgggtgtaggtgctgcgcgggagataggcggccaccggttgggcggtggcgcaggacgctccgatcagcagggcggcattgggcggggtctcggggccgcaggcgtcgacgacgatgcggtcggagctgagagcggctgcccagtcggcacgcgtggcggcctcggggtcggtggccgcgaagcgagtgggacggcggacggtgatcccggggcgggcgcccgtgccgggcagcttgtggtgcgccggggtgtacggggaggactcggcgtacacggtgctgcccgttcgggaggggacggcgctgctggcggggacagggagctgtaatgcggcgtcgacgcggacctcgatggcgtgctggatctgggcgtggttgcgggcggcgaagtcggcgaagcggctggacccgggcaggtctggtggagccccaagtcggggggcgcggatgatgcgggtggcgaggatgtccagcagcgggtcggggaagacggtgcccgggccggcgggggttccggaatagtcctggaagtcggtggtcagcaggatgacgggtacgccgcgggcggtggcgtagccgatctccatgcacacgccgtcgtccgggctcgggccgtgggtgatcgcgatgagggcgcggatgtggcggagccggttgcggtcgagttcaccgctcccgcatcgtcatcgaggtcgacggcgtacagcactacggcctggagaacccgcccgacgagaagggtcacccacactgccgtgccgcggctgtatgcggagatggtcgccaaggaccggcggctgcgcctggccggctacgagatctaccgcttcggtggtttcgagctcaccgcgccgggcggcgagcagatcctcgcggccttcttcaccgaactcctcggtcggcacaggaagccgcccctgtgagccgacgccataaggcgcgaagaccttcccgtgcgcggaagagatcgcgcggttgcgggaggaggccgagcaggtgcaggccgcgctcggcgcctcggagcgcgcgcttcagcggctggtggatgcccgtgcaacggtggccgaggtactggccgagccgccttccgtagtcgcggagccggtgtctggcgcggtggcgggggcggtggtgccgcggcggaccggggacatggccgcgtcggtcctcgcgccggactaccagcagatcttgtcggtgctggagtcggaagcggggcgggagggcatgcgctgccagcagctggccgtggccctggggcttcaggcggtcccggcgaaggtggaggggctgcggtcgaaggcgaaacgcctggtggaacgggggtgggcactccaggtgcggccgggagtgttcaccgcgctcgcgatgccgaccgtctgaagtcggctgggcggcgtccggtcaggcgtgcatccgatggcggtctccgctccctgcgcatagggcaggccaccgtgcaaatctccctggtgaacggccagttcaaccctggaggtgcccgatggccttgtcccagtctgacctacaacgcctgctggagtcactacgcacgggcagggcggcgggggcggtcggcttctgcagctgcgtcggtcctggctgggcggggacagcggcgcggttcttcgcggtggtggtcgggccggtggtggcccacgcgcgggcttcggcatcgaaccgcacctgcgtctcccgcgcggtgccgccgatgacgacctgggcgcggccgacgtgcttggtggacttcggcgtgggatggatctcgggagcgagcatgcgccaggcgttcatgctttagctggcgaggatgcgggtggtgaactgctcgcggacctcctggcctccgagggcgcgggcggtcgcggactgcgcgacaaggaacacgtgcatgcggacccgacggcccatgaacagaatctccatgagcgcgtcgatcgccggagaggtcttcgggtcaccggactcgcggatcttgtcccagtagcgcgccagctgccgcatggtggcgttgacctcttcgaggaggatcagcagcctcgcgccgatggcgtccgggtcggcatcgatgccgacttcgtcggcgacgcgcacgcggcgccggccttccattccgagctggaccagagcgtcgtggatgtcggcgatgtcggcgatgtcggcgcagtaggtgacgtccgggatgccgcgcgcccaggcatgggagatccgcttgtagtagaggacgaacgcctacgagccacggtggatcatctggcaggcgatgcagcgcaggatgaccgacttgccgccgacggtggaggcgtagaccaggatgtgcggcgaatcggcatccaggtcgacggagaccggcttgccgccggagccgatgatgggcgcaggctccgcagccttggccaccaggtcgcgcaccttggggtccttgaaggcggcctccgccggagacttgcgggtcttcttcaccagcacgtacggcttgcgttcggccgggtgccaggagaacgtcacgccctccagggcgagtttttgggtgatgaggtcggcgaccaggtcgcgggagaaccgcaggtgcgtgtcggctgcgcgagcgcctcgtgcagtgggacaacccactcacgcatcaactcccggcgttcgcgggacagcagcccgtacgcgatgccgccgacggccagggcggaggccgcgcctatcccgccagtctccagcgtggccagggtggcgtccccggttctcccaaaggtcctggaaggcgtgcgcgaagtcgccacctcacgcccccggcgcacgccaaaagcgcgctgactcgccgatgcgcaaaggtttgcaaccacccgccagagccgacgaggagcacaccgccactaaattcgaagacccgatatggccaacctcacccaataccggtaaatctttaggaaggtgctgcagtgcgtctgttcgccgatcatgtctcgggtccgccgtccgctgagcgattcgccgggccgctgtggttgcgggagcggcccggtggactcaatgagatcgaatggcggctgcgtcccggtttgcccgcgtttgtgctttatcacgccaggatgacgtcgtcgatgtccctgttgttggcctgctgcggcaacgcgttcgactcgactttggccgcgatgcgggaaggcaccgaggagcatttgcccaaggagatggcgaagcactggacgtccttcgcgcacatggtggccaatgggcagcgaggcgatctctccgatctcgggatcacgttggtcaccgaccccgttgacggtgtgaagggtggttgtgtcgccacgatcgtgagcccccgcgggagcgagagcgagctgaaagacgccctgacccgggtgatcaggggagcggcctccgcgatcggggagggggtggaggcggctgagcgttcaccccggatccacgggctgctggccgctcagtcggatcacgcggtgctggacgaccggctggagaccatcgccgcgaccgggttccgtttcggcgccaccaggtccctgctcgacctggactggcctacagaatgaacaccggccgtccgtcgcgaacggtgtagagcgggttgccgagcttgtcgacgccggtgcggcggatcaggtccatcgcctcgtcgaacgtctcggcgacgcggtggatgtctcggtcctcctcgaacagccggcgcgcggtgtccacgtctggcagtgcgccggtggacatgaccaggccgccccaggccagcgcgcggacatagcggatccggtcgaacacgccggccagaccggcaggctcgaggatcgcggcggacctggccaccgcatcgagatcgggagtgcggttcgccatcgccgcgttgagcaccgcggccgccagtcgggtgaacaccttggtggcgccggtggcacgatcccgcgcgatctccaggggatagatcacgccggacgcctccttggcgacgtcgcgcagcagggtgagcagctcctcgccctcaccttccgcccgggacagggcggcccgcgcgacctggaaggagtgccgccagtcctcgctcgcgtcgtcggagaaccagtacacgggcgcgtcgtcgccgatcgacagaacgatcgcggcgcagccggtgtgggcgtcgatggagacgtcgacatggccgtcgaccaccgttccgacgggcagtccggacgcgtacgtgccgctcatgaccgactgctcgccgtcggtgacggtgtaccggtcgcgctcgtcgacggtgaccgtgaccgggtggcggccgagtgacagcaccgtgcgctggaacatcagcgcgatgttccggacgaggtcctcgtccggagcgtgttcgagcgtttcgtcatgcagcgcgatgagccggtccgcccccaggtcggcggtggcgtcgtcgacgttccaccgcctgttgctgtggcgcgcccatgcgtcgaactccgtgtacatcttgcggtcccggtggctcgcgaggaactcatcgaggttcgcggcgtggtccgcgcggccgaagtcgatcacccgccgcacgaagtactcgatcatcttgtcgaccgcgcgttggttgtcgtcctcgtcgagcaggtgggcgatcaacccgaggtcggtgtacaagtactcgatggcataggagaagaacagctcggggtcgccaaggcgggcgtcgactccgatgccggcgctccacagcgccttcaccagcaagtagccgggcaggtagccgccgtcctcgggatcggccggccggacgaggacatcgcagcggcgggtcacgacctgccgctgccgacgcgtcgaaccgaggatgacgtcgagcacgttgcgggtcaccgcgtcctggtgctcctccggttcgaaggacgcgatcgcgccggggccgaagtagtcggcgacccgggccaacaccgggcacagccggggcagcgtgccgaacgacgacaggtcgaactcggcgaacagtgccagtccctcggcgagcgggcgctggagcgcgatgaatgcctcgtaccgcatcatggcgccggtgatccggcgcgcgacatccttgtcgcgccgacgtccgctgcggtaggccgccgcatcggtcagcgcgcgctggtgcagcaggctcactgccatgccgacagtgttcatgaagcaccagtggtgggtcgcctcgtgcaggaaggccggcaggcagtcgggcgagaggtgccgctcgatcaggccctggacgtgcttgcctgcccggaaggacgagatggcggtctggttggtgatcggattgatgaagctgcgcccgctcagcgccgacgcgaagtgctcgctcagttctcgtcaccgaccatcttgatcccagggaatgccggtggcggaggcgagctccttcgccaatgcggagtcgatggactcgcttgacgtgtcccgccacttcagagtcctccgctcgatccggccgtcgggatgctcgatctcgacgacctcctcgaacgacgtgccccggtggcggtacagcagatagctgaccatccccttgagcgtgtaggcggaagcggccaccacaacggtcaccacgccgagatcgccgaagctcccctccggcacgggctcgtggtggaacgcgatcgccccgcggtcgacgaactcgcccagctcgagggcatcggacctggacagtcctggtaaacggaccttggttgctgacacggaagtctccaaacaacgcacggcggagcggcatcgtaccgcgcgatgttgccgtatcgcgttgaaacggctggtggagggctcgttcgagctgccggctctctgcacgctcaacgacctggccactgcgattcgcggccgggtcaacgacgagatcttcgcgcaggtggtggcccggttcggggcggagcgggtggatgggctgctcgcggtgggggtgggaggcaagagcgcgttcaaccggctcaagcacaccgcgcggcgcccgtcgtggacgaacttccggttgcagttggagcacctggagtgggggggaaggtccagccacgtcatggaccgcgatcctggacgcggtccggctcggccctgcggacgacgcgaccgcgatcaccgccacccagttgagtggtgtcgtcgagcggctcatcgcagccggccagtggcaggccggcgacccgcatatcgtgatcgtcagcgacgctggctacgacgtcacctgcctggcctgggtcctgcgtgacctgccggtcgagatggtcggccgggtccgctccgaccacgtgatgcgtctgccgaagccaccgcgggtgcacggtgtcaacggccggccgcccaagcacggtccgaagttccgcttcaccaagccggagacctggccagagcccgcgatcaccacggtcacggacacgaccaactacggcaaggccgagacccaggcgtgggaccgggtccatccaaggctcacccaccgctcctcctggctcgaccacgacggtgaacttcccttggtcgaggggacgttgatgcggttgaaagtcgagcatctatcgaaggacagggataccccgccggtgtggttatggtcctcgaagaccggcgccaccccggacgatgtggaccgtttctggcaggcatttctccgccgcttcgatctggagcacaccttccgcttcgcgaagcagaccctgggctggaccaccccgaaactccgtactcccgaggcggcggaccgctggacctggatcctgatcgtcgcccacccccagctccggctcgcccggacgctcgctgaagacctccgccggccctgggagaaacccaccacctccgaccggctcacccccgcacgggtccgccgggggttcaggaacatccgcgctcacctcgcctgcccgacccgtgttcccaaaccccgaggcgccggcgccggacgaccccccggcgccaagaacaaacaccgggcaccccgctacgacgtcggcaagaccgtcaaacgccccgagaccctcaaggccatcggcaagcctggaagatcttggtagataaagaacaagttgagttcgtatttctaatccgtggtgcttcgggcggtgttggtgcgagcgttcacggttgcgtgcggtgatcctgaaggcctggcagccctgcacgtcgcaggcatccatagccggtccgcaaggtgatccagaggaagggcgaggccacccagtacaccgaggcggccgccaagagcatgaagaccgtggcggccggccaggccgagcaggccctgcggaagaccatcgccaagaagtaacccgagctgcacgacatcgagaccaaggcccgccgctcgcacatcgtcgtgcacaagcgcgcggccgccgagcagtcccgggcccgggctcaggagtcagccgccgcacaccgtcagccgccctcccagggccgtggagggccgtccaggagcggccggtagccctgttaggtccaatggacccaacgcgatgtgagcaggtatgacggagccccggtcggctgcagcgaggcgcagctgaccggggctctacgacggtgtgtcagggactgtcggagagtttggcgaggaagtcggcattggcgcccacgtcgtgaccgaggaccacctggtggtgcggaagggcggccaggtgttcggcgacggtggcccgggccaggtcgctgccaccgccgtcgatgccgtgggcgaggccgaagtggtccgggtaacggtcctcggtggccccgctcatgaagtcgtcctcaccgagggtccgttcgccgtcgaccagggccgggacggcggccgggtcgatgcgggggaacagcagcgcggcggcgcggccgccggtggccagctccatgccgaaccagctggcgaactggtcggggaagacctggaccttgcgctctcgcttgccgccgggctcccacagcggctcgcgccgcccggcgagcagggcgtcggtgacgtcctggtgctgggtggggtggaggtgttcgccggcctggagccggtcgcggacgacgtcgtacaggccgagggcgtccagcaggcccagcccgatggccgctgcagacggccagggcaacacgcgcaggtcggcgccgatgcgcttgatgaacacccggtcgttggcgaggagctgggcacaacgggaggccaccagcagagccgtggtcgtcttccctgcgcccttgtcgccaaaggcgagcagggcccggccgtcgcggacgacggcggaggcgtgcaggagcgtccatccgtcccgcagcagggccgcgcggatcatctcccgggcgatccgggacgcggccagcgccacgggctgcggggcgtggccggagatggtgacgtggccgcccaactgttcggagcggtaggcgagctgctcgtcgggcgagacggcggtgatggtgcccgtgctgtcgcgggcgaggagcagccgggccttggcgtaggtggcctcgctgtgcggcacggacgccagcagcgcggccaggtcggcgtatgccttctcgtcgacgtcggcggtgaccaggggcccggcgcagacgctgctcgtggggacctcgaacgcgttccaccacggcccgaagtaccggcgggaccagtcggtgacgaaggcggtgttgctcaggacggttacgtccgcgtcggcggcctgcagccgggtggcggtaggggtgctcacgtcgtctcctgggagttgggtgtgggtccggacggccgtaacgcctggtaggcgtcacggagtttggtggcggtcgcggccagttgcgcgtcttcgtccgcgttgagggcgggcaggcacgctacgggctggccggcggtgaagcgcaacggaattccgagccagtcgccgcggtgttcggcagtcagttcctcggtgccgtcgaccaggccgagggccttgcgcagagtggacagcaccgcgccggcgggtccggagcgggtgcggccgacgcccgcgctgatctggccggggcgggtacgcagttccgcgcgtacctccgcaagggggacggcggcgggcgtgccgttgacggtggtcgacgaggcgcacaccaccgcaccgtccccgtgttcgccgatgacgtggccgtgcacggtggttgcgggcacgtcgagcaggtgggccagggtgagccggtagcgggcggagtcgaggttcgagccgattccgtacacgcgcgggcagccggaggtctcggcgaacagccgggtcatcaggtcgaccgggttggtgaccacgagcacggtcccctggtagccgcgcagtgtcgtggccagagcacggatcacgggagcgttggtcaacgcgccgcccatccgtacgtcggcggcacgggtgttggtgaacgcggcccgcacggcgacgaccacggcgtggcagccgatcaggtccgccacccggcgggcttcgggctgcacgggcgatccggtggtctggcgcatgtcgtcgaggtcagcggccagcgccctcgcctgctcgacggtgcgggagacgacgagcaggcgagggcagatgccggaggccaccagcgtggccgcgacggtctggccgacggcgccggcaccgacgacaccgaccgagcccaccggccccggcatcacgcggcgaccgcctgagccaggccgagcgcgctctcccacacggcgcgcgtatcggcgccggccgccagctccgagctgagctgatcggccatccggcacaggtcgacggcccggccgatgagagcgctgccccgaccgggcatcggcagtacgccgggcgcggacaggtacgtggtcaggatgttgacgctgtccatcagccacagcaccagcagctcccgcagccaggagcggcggacccgggcgggtaggacgtccgcccgcgccgcggcgaaggcgccgaccccgcgcatggcctgctggcccgtcccggcgccgggccgggcagcggccagcagcagcacggttcggctgatcagcttcgcggcatccaccgtgggcggggcgagcagcaggccggggtcgatgaacaccggctgaccggatgttccttcagggaacaccacgtgctcaggcttgaggtccccgtacgccagcacccgccggctcgcctgctggggcagccccgtggcctggagccggtgcagccggaccacgacgtcgcgcagcagcccgacgaccagggcgcgatcgccgggcgcgcaccgttcggccccgagccgttccacatacgtcgggccgctcagtccgttgaacttgcgctggaaggtcccccggatgctgtgctccccgatgccccgggccgggcccagtagccgggccgccgacgggcggtgaagccgccgcagctcaccgaacaagccctcgaggagatcggccgcatcgtgcggacgctgcaggagcaggtcggccagggtcgggccggtcaccgactcggtgaacagcacccctcgcgccaggccggccacgggacagacccggggcgagtccagctgggccaggagccgcagctgcgcggcctcccgatccatcagcgcgccgggacgctgcacgtacgcctgctgcgccgcccggacatccggccagggcccgcaggcgccccgcaggagcgagaccagcgacaccccgaggaaggcgtacttggcgtacagggtgcgcccgtccacgcggatccggcgcacgtagccggtgacgctcgggacgtggtcgccgaggtcgacgtcggcgcgcggccacaggccggcggcagcggcagcgatctcccgggcggcgaaggcgaacacctcgtcggcgtccgggacggggggaacgggaccgggcgatgtgctcacggctgtggtgctcacgtacgcctccaacggcagtggatgaatcccgcccggtgccccgggcgggtgggcgcatggtggctggggaggagcccccggctggccagttgaggagcggcccacctgccgggagctcccgtgcacccgagcccacggggacagggcatcgggcggcttggggagagatggtcagggagcccgccgtacgaggtgcgggcgttcgccgtatcggtcggggtgctgctcgacgcgttcggtcagttcgccgccctgcagcgctgggctggtctcaggcgcggcatccgccatcgagaccgcaagcggggcggccgttgcccggggagccggcaccatggcgggcggaatcagtcccaaagcggccaggacgagcacggcgcggcccggacgcgacggacgagcgtgggcgtcgctcaccgctcctccttggggtgcatgtccgccgtgaggggcgcggggttggctagcgcgcccgggtccgtggtccactccatcccgccgcccgccggcagcagccatgccaccgggcgtggccggtcgccgtccggggcgatggcccgcaggaccccccgacggccggtcgcggtgtcctcgacgtcccggccgatccacgggtgatcgcgatgcagcaggctgcgcttggtgctcacttggcctcaccgccgcccgtggccagcggctcccaggagtaccgcacctgtacgcagtgatcctgcagccagcgaatctcgcggtgcctcagctcgtgggagggctccggagcgatacacgcgggccaccggacgatcaccactcggaccgcgccggactccgccagctcccgcacccgcagccatccgtcacggtggcaagggtcgggatcgccgtacgggtccgtgaccacttctgtgatcgtcagcccgcgcgcctcggcgaagtcgcgcccctcggcctcggcacggtcggctgcgagcgtgggagtgagcttgcttcgctcagcgcacacgtacagcacagcggcgctggcagaagcagcgacggtgatgttctcccgggtatcaggcgtcctggtcatcgtggtgggcctcttcgtcgtcctgggcgcccggtccgcccccctcgggggtcggaggggcggaccaagcagtcgacggtcgtacgggtgcgatcaccgaacggccggtaatcactcaactcccctacgcgacaccgggtaagggagcagagtggaggcacggttgaactggttgaacgcacccgggggtcatcgatggcacgtcgaccgcgaacaccgaatgcagcccttgcggccctgatgcagtcaggaggaatcggaaacgcacagctcgcacgccgggtgaacgccgccggccgcgaactggggctccgcatgcactacgacaagacgagcgtgtcccactggctcgccggatccgttccaaaactcgaggcaaggcccgccgtcaccgaggcgctctcacggctgctcggacggcccgtaacgtgcgcggaggtcggctgggagaccgaggaaaagccggccggagagcgcgacttcgtggcaggagtgatcgacctgagccgggcagacatggatcccacacgccggggagtgctgaagaccgggatgtacgccgcggcgctggccgtgccccgatacgaggacgtggcggggcggttggagtcggcaacggccgggcggacggtgcacatcggccgctccgacgtcgagaccgtccgcaccatgaccgacaaggtcgccgacatcctggaccaggtcggggcaggccacgcccgcccgatggccgccgccttcctcgtcaacaccgccggcccctacctgcgcgcgagcggcacggacgaggtgcaacgcgacatgcgggccgctgtcgcggacttcgtgtacctcacgggctggatggccatgtacgaagaccagcagggcctgggccagacgtactacctgcgcgccctcgagctcgcgggcgctgccgaggaccacgtcacctactgccgcaccctgcgcggcatgagcctgcaggcgacgcacctaggccacggcaagaagggcctggaactcgccgacgccgccgccgaggcggcgccctccgccggcccgcgcctagtcgccttcctgtgcggccagcaggccgccgccgctgcgatgaccaacgcccggaacaccgccctggcccggctccgtgaggcggagagcgcgctgtcccgcgccgacgaccgacgcgatgccgtaggcggatacgaccaggccgcctacttcttccacgaggcacacgtgcgctggcacctcggcgacaaggacggctccatcgcctccctgcgccgctcgaacaccgcccgctccccgctggaacgccaaggccgcctgcactgcctcggcgtgaccgccgaacgccagttccgcatgcggcacatcgaagccgcctgccagacctggggaaccttcctggacgagcacgtcacgatctcctctgcccgaggagacgagcacctgaagacgatgctcaaggcgctccccgcctaccgccgcgtcgccggagtacgggaactcgaagaacgcgcccgccacgtcgccactctcaagacagcctgactttcggcgctcaccccacagcggaacggggtgggcgccgtcacacgtcatcccctatcaggcccgttgggtctaacagggacaacatccggagcggtgacgcgtatgaaggtgctgcgtccggtgacggggttcagcaccgcgaccttcagcggagaccgggcggcggcctggatgcgcgagagccacgtctggttcgggaccaggatcgtcagctccgccggccactcgatgagcgcttcgagatcggggcagaccacaccagccagcgtgaacccgtcgcctgtccatcgcggccgggcgtagacgagcagcccgttaccgtgagcggggctctgatctccatacatgatcgctttgcccgaggcggagcggaccatctgcgtgaacgcctcccacaccgtggcgtcaaggcccgtgcgctggaaaaagcccgccagccgctgcaactccgcctgccactccagcaactccgcctgccattccagcgcccgccgctcggcgtcttggcggtgttgctcggcggccgcggctcgctgctcggcctcctggcgacggcgctcggcggcagccacccgtctgacggcttcggcttcggcctccatctgggcgcgtgccaaaaccaggtcctcgtacgcgggcgccgtccaccacaccgtgccattcgcgccggtgtgggcgtgcacccgcccgtcgaggatccacctgatcgcgtcgccgagcgggcaggtgatgtgcacccactttgctttcgccttcagcgtgcgtggcgcccagtcatagcgcgccatcccatgccacaccgtccaggtctcgccccgccggcgcggagagcgcaccctcagcgagggaacgacccgctcccaaggccggtcctgcagggcgacccagcacaccgccactccgtcccgcgcgtaacggtccgtacgcatacgcgcctcatcctgcgtcatgggcgacaactgcgcctccagagccatgaaagggcggtcgtgctcgtcgaagaccatcacgtcggcccgccagttccggacctcgctgctcacctccagctccgctcgccatcccgccgcccgagcagccacgaccagctccagcttcaggaggtggtgctccggtgattcgttcgccagctcgcagtccgggggccgcacctggtggtagaagtgccggacgacgtgctgggaggcccgggcgaagacccgaccgccgcactccgggcatgccagccgcagtcctttgacccggtggacgtccgtccaagcgcggtcacacccgaggtcgtccatcgacgcgtccagtcgaccccagaccgggtgtacggcggtgtaccccatcacccctccctcgtgcgcccaacggcagccagcgtccccacaccgagacgaccccgcgccgtagatcctgctcgctgcgccgccgcgttctccgccgggtcctccgccctgcggcggacgactcccgttccggacggtgtccgcttcgcaggtcacgctcccttccgcgccgcggtgatgtacgcggccgcgcgccaaccagagggagaaggacaggcagcggagagcagggcgacgggggtctaccgggagcgagcggagcgccgacggcggacgcgaggaacgggcgaggcccgcggcgacggctggcagcgcaccgaggaggacgagcagctgctgcggctggccacccggtacagcacgctgacgctccaccaggccgcctacgcctgttggggcggacggatcgaggccgcccggcggcgggtgcggctgatggtcgaggccgggctgctgcaccgcctggccgtcgcggatgtcggtatccggctggagagcgaagggcgcactgtgctctccgagcgggaggtgcacgccgccgaagccgtaccaggccgcgcggcggagctcctggcggaccttggcgtgcaccaggtcccggtcggcgtccggcgcggggaaatactcgctgtgcccgtcggggcccgtgccgtgcactggcccgacctcgtcgtggtgctgcccggcggccgcctcgccgcgttcgaggtcgagctcacagccaagcccgcggccgcgctccggacgatcctgcgtgcgtacaagcaggcccggcgcccggtggcctacctcgccactgagcctgtcgtgggccagctgcagggcggccccgggccgggcggccggtgggtcaacggtgtcgcccaggagctggaactcctgccgccgggcgggcctggcccgggcgccgacgggcaccttcaggtgcggccgttcaccgccgtcgacccggccgtggcccgccggacagcccagcaggccgcccggctacgaggtggataacgcgcagatcacgcccgttgccaccccggtatccagcgtcgtctgcgcccagagcgtcaacattcctcgccggtggccgcttctccgatcgcctgctggacgaggcggagctccgtttcgtccagcgcgtccagcgacgccttgaggttgagagtccgcgccgttggcgtcgtgttgtgctcgtcacgcttgcgcgacgggaccggtcctggcccagtggccaccagggggaacctcaaaactgaggcgccagggcttgtggccttccgccgtgcaggtggcccataggcgaatgcgcgcgccccggtactgctgccgccagcgttgttctccctcggcgtcctcgtagcagtccggccgcaccgaggggtcggtggagaacagggccatgtcgccgggttccacgaagaccggactgactgcgcgccccaagtcgtccgctccgtcgattcgcggccggaagcgcgttgggccccagatcacttgtgcccgcatctctcgggtggtgctgccggctagttcggggtcgttcccgcggtcgcggtcgtctcgcacctgcagttgcacctgaagacgtcccagtgctgtggggccctcgaaacgtacctcaaggcggtcggcctgatggcgtatccgaagctggggggtcagggcgttgtgccagcggtcccgctcgatctgcgcgacagacccagccgtcgcgttggcttcccgtgacgaccgccatgagtacgtgactctgtcggggatcttggagcgtcgaggtcagctcggagatgccgtcgccaccacgttcaacgactgacccgcccagcattctcaccccttccctcagtagggaactgcccccaaaggaacagcgtcccccagtaactgtcagcgccagagcggttgccagggcttcagggatggggagaagaccttccgcggcgcagcgacggctgtccacgacccttccggcagctgatcaacagcgcgtaatctccatgccgccacaagatctgcgtttcaggtcggggggagaccgcatgcagcacctttccacaccactcgccaggactctgggcgcggcggctttgttgtcggcagccgccgcatggggcgcggcctcgatccggtacgaagctgacggccctcgcctggacgttctcgtgccgctggccctggcggcggtgttcgtcgtgggctggctgatggcctctcggtcagcaccccccgttaagctactgccatcgaccgctcctccccgggagaaggtccctggcaagctgggagcggtgcgccgtgactgggggctcgtcgccgcggcctacctcaccgtctgggcaccgttcgcggcggccaacagcgcctacggcggccggggttcacagctcggtgccctgtactgcctgctcaccttcatcgtcggcgccgtgctgtccctgtgcaatctcgcgctgctccagagcaacctcggtcgatcgcaacgcatgctcaaggaggacgccgccgcgggcagcgtccacgctatccgcgtccggttcggtaccccagtgctggagatgtaccgatacccgacggggcagggtgccggcaggatcgccgcctccaccacttacggcgtcgagttggttcacgagagcgacagcggcgagcaacggactatccggctccgggccatgaaggccgcccaaagcgacaaggtcggtgacaagcacctcacctatgccgcttcccaactcgtcggccacggcggctggttgtgctggcctgcccggtggcgtgacatcgcgggcacgaacaaggacctcaaggtccccgccgccttcgcctccgactccggtcacgtggtctggggcgagatgcagcaggatgactacgcgtactatctgcgcgacggtgccgcaccattgtgcgagaccgaccccaggctcgccgtcgcgccgcttccccggccgtcgcggtacttcccgaaggtgcacgcctcgcacctgcgtgtcgcggcggttggcgccctcctcgccgtcccgttcctgctggatgccgtcccgtactgggccggtctgctgttgggcgtggtctcgggggccttagggctcttggcggggatgacgatggacggagtgggcgtggaccaggaaccgtggactgtacgtacaacctcccatccgtcactgcagtaggcgcagcccgccaccatgcgcgacggcacggccccggccctgcagggtgaccacgatccgcccgggaggcggccggacagccgacatgcaccgagtgctgaatgcgcgcatccgcgcggcgggagttcgcccacggatacggcatgcagcgctgtcgctaccgcggacagggaaaggctcacatccagcacgtcctgacggccatcgccgtcaacatcgagcgcctcagcggactgcctccaaccgaagaagcccccacgccccgccgaccgactgcgttccagaattacctcgaccagcgcaagataccccggtcgaagtcctggcgtaccccgggaagctgacctcgacgctccaagatccccgacagagtcacgcactgacgcgaacgcggccacaccgctgagtgcggctgcagccgcggcgatgctggtatctgcgattcccatgcgcgcggactgtagctcagccagagggggtcacgtccgctggagtggtgtattgacggccactcggtgatctcgttttgaggctatgcggtgagttcggtgggcagttcggtctcgtcggtttctgactcgatcgggtggaggcgggccttggcgaggagctcgcggcccatgtagcggcgggcctcggtccactcgtcgttctgctcggccagcaccgcgccgaccaggcggatcagggcggtgcggtcggggaagatgccgaccacgtcggtgcggcggcggatctccttgttcaggcgttcttgtgggttgttggaccagatctgccgccagatctcacgtgggaacgcggtgaacgccagcaggtcgtgctgagcggcaaccaagtgggcggcggccttgggaaacttggcctccagggcgtccagcacgtggcgcatctgggcctggacggcgtcggtgtcgggctgttcgaagacggtccgcagcagcgtggccacccacggctgggcggacttggggacctggctcagcaaatttcgggcgtaatgcgtgcggcatcgctgccaggatgctccgggcaggacggcgccgatcgcggcgaccagaccggtgtgggcgtcggagacgacgagctggacacctttcaggccgcgggcggtcagggagcgcaggaaggcgagccagccggcgccgtcctcggcggtggcaacgtcgatgccgaggatctcgcggtgcccgtcggcgttgaccccgaccgcgatcagcgcgtggacgttgatgatacggccgccctcgcggaccttctgggtcagggcgtccacccggacgaacgcgtaagggccttggtccaggggccggttgcggaactcggcgacccgctcgtccaggtgcttggccatcgcgctgacctgggacttcgacagctgggtgacgccgagggattcggcgagtttctcgactctgcgagtggagacgccgagcaggtaggcggtggcgaccaccgagatgagggcctgttcggcccgtcggcgtcgttccaggagccagtgcgggaagtagctgccctggcgcagcttggggacggcgagttcgacggtgccggcgcgggtgtcccactcgcgtgggcggtagccgttgcggtggttgacgcgttcgtcgctgacctgcccgtattcggcgttgcagagggcgtcggcctccgcggacatgagcgcgtcggcgaacgtcttgaccatcgcgcgcagcaggtcgggactcgccgcggcgaggttgtcttccacgagggcatgcaggggcagactgtcgggtgcggtcatcgtgctgatctccttcgaggcttcgacacttcgaagatcagccggtggccgttcatctatgcgggcctcatcccgacgccggagcaaacccccggatcaggtcgaacccgtacaccacttccctggacgcaaccgtaacgggcgcggtcggaccggaagagggtccggtggcacaggcgagcgttcatggccgccagcgcctcacgcgcatcatcggacgggcctgcgagggggaggatctctgtggcggtcatgccgtggaagttctgcggcatcccgcctctgcggcgctctgaccggccttggtcctgcggactgctccgcttcccaccgtgttcgcttggagcccagtcggccgacgccgttgacgaggtacggcgtaccgtcgccgtcctcgctgcccgcgtcccgtcgccgcgcggcgcccgccgcggaaacgattcacacggcgccgcgcagccggaaatgaatcgcccatgacttgacccccgatgtctgggtacgcagagcgggcggccgactcagctggggcgcgaggagcggacaagatggacggggctgccttgggtaccacggccgcactctcttcggcacgccggttcattccgtcgacgcgtgccctggtgcgggtctcaccgcaccatgagaaattgacgggcaaaaggccgccttctcatatttcgccccatgcgttcgcctgccacagcactcgacactcggccaccgcgaccgtggccggccagacacgaaggaagcgtctccgatgagcgaggccaaccccctcaagcgagcagcacggaagatcaccaacagcctccaggacaacggcgccacgcctgaggagggcatccccggcaggcccggcccggagtctccctccgtggcggagccgacggagccgcgtgacccgctgccgccgaagccggaccagagcggccccgacaccgtgtcgcccaccggccagccgaccggcgccgaccaggcccgaatggctcagtccggcagctacctgacgaccgcccagagcacccgcctgtacgacaccgaccactcgctcaaggccgggccccgtggaccggtcctgctgcaggaccaccacctgcgcgagaaggtcatgcacttcgatcacgagcgcatcccggagcgcgtggtccacgcgcggggcgcggccgcgcacggcgtgttccagagctacggtacggccgcctccgtgaccaaggccgccttcctctccgaggacaaggagacgccggtgttcgtgcggttctccacggtgctgggatcgcggggctcgtccgacaccgtgcgggacacccggggcttcgcgaccaagttctacaccagcgagggcgtcttcgacctggtcggtaacaacatcccggtctttttcatccaggacgcgatcaagttcccggacgtcatccacgcgggcaagccgcacccggaccgggagatcccgcaggcgcagagcgcgcacgacacgttctgggacttcgtcaccctgcacaccgaagcgacgcaccacaccctgtggaacatgtccgaccggggcatcccgcgctcgtaccgaatgatggagggcttcggcgtccacacgttccgcctggtcaacgccgagggcgccacgacgctggtgaagttccactggaagcccaaattgggcgtgcactccctggtgtgggaagaggcgcagatcaccaacggcgtcgacccggacttccaccgccgggacctcgccgacgccatcgaggccggcgcccacccgcagtgggagctgggcatccagaccttccccgacaccccggaccagaccttcgagggcatcgacctgctggacccgacaaacctcgtgcccgaggaactcgctcccgtgcagccggtcggcctgctgaccctgatgcgcaacccgtcgaacttcttcgccgagaccgagcaggtcgcctttcacgtcggccacctcgtcccgggcgtcgacgtcaccgacgaccccctgctcgccgggcgtctgttctcctacctggacacccagatcacccggctgggcggcccgaacttcccgcagctacccatcaaccggccgcacgccccggtcaacgacatgctgcgcgacggcatgcaccagacggccgtgcaccggggtgtggctccctaccgccccaattcgctcgatggcggctgtcccttcctcgcgggagcggacaccggcgcgttcgtcgagacgcccgtacgcgtgccggaggcggcgaaggtccgggaggcgcccgagtcgttcgcggaccacttcagccagccgcggcggttctggctgagcatgagcccgatcgagcgcgagcacatcatcgccgcctacaccttcgagctcggcaagtgctacgagcaggccgtcaaggagcgagcgctacaggtcctggcgaacatcgacccgaacctgtgcgctgaagtggccaccggtctcggactgccggccccccagccgaccgtgcccctggccgaggtcgaggccagccccgccctctcccaggtcggcgggacctggcccacggacggccgggtcatcggcatcgtcatcggtccggacggcgacctgcggggcgtgagcgcggtgcgcgaggcggtcctcgacgcgagcatggtcccgctggtcgtcgccccggccggaggcgttttcggctcgggtgagggcatggtgacggtccagcgcacctacgccaccgcgcggtctgtcgagttcgacgcgattctgctggccgggacaccgggcgtgggcggcgacgcgtacggcgcccgtgacgccaaggcgttccccgcccccgcgcagcaggcgaccggtgacccccgcgtcggactgctggtgtcggaggcctttcggcacggcaaggccgtcggcgcgtgggccggcggcgaggcgttcctcgaagcatccggggtgcccctcgacgcgccgggcgtggtggtcggtgactcaggcaccggcgccctggcgcagctcaccggtctgctgggcaagcatcgcgcgtgggaccggttcagggctgtgtgagcggtccgcgtccgagcggcccggccgccgtccgggtttcgcacccgacacggccgggctttcgtacgccgggtcacgccccttccgccgacgcccgccgcgccgtctcgtcacgcaagggatgaccatgcagacgttcctgccctttcccgacttcgccgcatctgccgccgcgctcgacccgcggcgcctgggcaagcagcgcgtcgaggcgctccagttgctgcgcggtctgatggttcccggctacggctggcggcatcacccggcggtgcgcatgtggacaggctacgaggaggcactggtgcgctacggcctggaggtctgctgcgtgtggacggcggccgggcgcgcggacacgtgcgccggctccctgatgaccgacttcacggcccaccgagccgatgtgggcgtgcgtacgcaggagcggcttgcagcggacggcgagctgccaccgtggctgggcaatcccgcgttccaccgaagtcatcggtcggcgctgcggcgcaaggatccgggcttctacgcacccctgttcccggacgtccccgaggacctgccctacgtctggcccgcctcggaccggtctcgctaggtcggaccggtctcgctggaaaaagcgtcgagcggggcggcccgtcaggtgtccatcagtgcagcggcctccagggttctcgaagagcctgcggggcggctcagcggtggcgccgctcccgggcgtcggcaccgaagccgttgcgtcagagtctgctgaccaagagcgccatcgtgcaggaggggggcctgcggctctcccctccaggggaacgctgtacgcactcgccggagcaggcgtcagttgcgtcctcgtccttgcggaagccggcgatatcgacgatcaacgcggtcggccggatagcttcccgcatcgtcccgccagacgggcccgcacatgcgccggatcccatggaccggtcggttcaacgcgagtggatgagaagcaacgcgatgtcgtcactgcggaacgcggattgccgggcgtggtcgaccaggctgtcggcgatggcctccatgctcaaagtgtcggcgtgagccagttggttggcgaggctgtggatggcgtcctcgatgtcgacgccgggtgcttcgatgagtccgtcggtgtacagcgcgagcacggtgccgggtggcagggagacttcggtggtggggtattcagctgcggggtcgatgccgagcaggagacctggctggaggtggaggacttcgacgtggccgtctgggtggcgcaggatcggaggtgggtggccggcggtggccagacaggcgtggtggtgggtcatgtcgaggacgatgtaggtgcagctggtgaacaggccggagtcgaggtcggtgagtaggcggttggtgcgggcgaggacttcgccaggggctgcgcctgcggtggcgtggacggcggtgcggacctgtcccatgagggtggcggcctgcacgttgtgaccttggacgtcgccgatagctgcagcggcagtcgtctcgtcgaggcggatgaggtcgtagaagtcgccgccgatgcccatgccgcggctggcggggaggtaacgggcggcaacctcgagcccggggatgcgcggcagggtgtggggcagcaggccggcctggaggttgcgggcgagctgatgtttggcgtcgtagagatgagcgcggtccagggcctgtgcgatcagtccggcgagggcggtgaggacggcgcgttcttgcggggtgaagagatggggctggtcgtaggcgaggaccagggagccgacagcgcggccggaggtgatcaacggcaggaaagcccaagaagccatgccgtcctggaggacggcggcagggtgggcccgtttcagctccgcgaagctggcgaagaagcaggggatgccagtagtcaagacatgcgcggcgggggtgtcggcggtcaggggggtggcgtcgaagcggtccatgaggtcggcggtatagccgcggtagccgatgatgtgcagtcggccctcctgtgcggtcatcagggcgagggcccgcgcgccgaaggcggccaggacctggtcggcaaccctgttcaccacgtcgcatacgcggacggcttcggtgagggcgacagcaagatgcgtgaggctgtagagggcgttggcccggcccggttcaacgggcggcgcggggtggaccaaccgcggagggtccggggtatgagccgacgggttggggacgatgcgcacgctgatgccggtggcatccgggtagaggtggaaggacagccagtgatccggtgggcgcagcgtagtgaaggacgtgggtaggcggctgagcgctgcggatcggtagcggtcttcggcgacgtgattgtccagccacggcagtgcctcccagggccgcgctcccagaaggtcgaaaacaccgacgccgaggaggtctgccgcggccgtggtgatgaaggtgatccggccgtcgacatccagggcgcagcagccgtcgggaagacgctcggcgaagccgaccgcggcctgtgcctcgtggtgcccggcggtacgggtctgcgacggaggcagtattcgcggctcgagcccgggcaccacggggtgaccgctgttggcggcttgccgcatgatcacgcccagtcgctcgcagacgccggcgatcgcatcacgctcgtgcgagctcaacgtcggtgggtgcgaggcgggccagtgcagcaccaggccgccccatacggtcgggccggtcgtgatcggggcggcggccagggcgaaggggtggggcaggacgagcgccagtttcgggtagcggcgcgcccgctcctcctcgctgccgatccacaccaggtggcgctcccgtacggcgtcggccaccggggtcgcagcctccagcgtcacccgcgcccacgggacggcgatccgccacgagattccgctcagcaccgccagctgcagcgcgggctcgtccggcgacagcaagtagatggcgctcaagctggcgccgctctcccgcgcgaactggagcaggacggactccagtgcctccgggccgaagcccgcagggaaatcggtggacgcggcgtcgggcacgctttcacttgcctctgcaagctccggatggtgatccccgcacccgcccgaagcgacttcgagcaccctctgcgctgatgcccaagccggcgccgatctgcgcccagccggccccggcccgccggtcggccggcaccgccgaacgaactagccgaccggccagttcgggcacctgcgccacaacagcgcattgacagcctccgggaacccgcgccccgggcagatcgctgctcccctgctgtgccccggcctgtatgcggctgactagctccgttccgacaagcaccatcgcccgccgctcctccgtcgccgccagccaccgccgcctggcacgccaggccgcctgccggtacgccgggcagcagtaccggcgtccacggccggacgaccgtggcaacaggatgcaacaccaacagcaccgaccatcactcacattcggacaatacgcccgccaggtggtgacgtcactccgatgccaggacatgcgcagaagaagaccgctgacgagcagccgcatggtggagcggtgtcggcgacgactgaaaagtggctcagccacgattcacgcgtcgccgacattcctcgccattcgcaacgtcgcggcccatgaagaagccgtggaatggtctcgacaggacgctttggaacacctgactgttctgtgcgtcagcactgtcctgagcgtcagcgcacattcgcacaactagaggacgacacctacctgagcccgaccacgagaacggcctcgaaagccacccagtccggcggatgatggacctcggggcgatgtcgatgcggaactcgcccgatgactgtcacgcggcgtgaacagctccggcgcggtggcgtggctgccctggacgtatgagtggtcgccgcgctgcactacggctcggccaaggtggggctccttcagcaactggtgcgcggccaggtcaccccgctgtggccgccgaccggtatcgccctggcgagcccgctcctgggcggcccgcgggtctggcccgggatcgcgctcggcgcgctcctggtcaacgtctccctcgggccgtcggtctgggccgtgctcgtgatcgtgtcgggaaacaccctcgcgcccgtctgctcgtacatactgctccgccgcacgggattccgtctcgaattggaccgctcgcgggatgcgctcgcgttgatctttctcggtgcgttcaccgggatgctggtcagcgcgacgacaggcagcgggaccctggcccacgccggcgtgctgagtgccgaccagttctggccgacatggtcggtctggtgtaccggcgatgcgatgggcgtactggtggtgacgccggtcctgctcgttttgcgctcagcacaccggccgaaggacgctccgcctacccgttgggtggaggggctgctgctcctcgcagccacctcctacatcggtttcctggagaccggcagcacacccctcaggttcctcggcttcccgagccgatctgggcggccttccgcttccaacgggccggggcagcgccctgcgccctggccgtgtcgaccttcgcagtcatcgtggcctgtctactcacagcgactgccggctactgggtcctcggtcgagggacgccccgtccgaacggcacgtgggccatgggcgcgctccttggctcgttcgccctaatcttcgccacctacgccccgctgttcgagaacgccgttgagggcgtcgtgccgcacgtcgcccggctgatgagcaactgcgcttccctggccgccgccacggcggtcctggccgtctcgttccagctcaacctggaacccgcggaagcgcaacggcgagtccgcccgcgtctcgtcctcttcgccacgtccgccctcggcatgaccgtgctgttcacgtacgagcagatgacgcatcgctctccgcaggtgtatgcgctctacctgctccttttcatctcctacctcggtttcgccatcgtcgacttcctggtgcaggccgtaagccagtcgaggtcgacccgccgcagcagcgtccggataggtctgcgcatggcggcagcagggtgcgccttcacactcgtctacgcggtgtacaagctgacggtcctcatctccctgggcctgggcttccacctggtgtccgaccattcggggtgttcgtcgctcgtgtctacgccgtgcgtcttcagcgtgacgtctccggcgctcgccgccctgctgatctgcgtcggtcgcacactgacggctgtcgtctacccggtcagccaggcccgacgtcgccgctgggaggcacaatccttcgaagccctcggtcctctctggcaagacctgtccgccgcaatgccgaatatcgacccggactttacgaggccgcttcgaacgactccgacttcctgctccaacgtagggtgatcgagatcaacgacggcatcctcgcccttcggccgtaccggtcccgcatggtgcaggagctggcccagaatgcgttcgacgctgtaacagaggcgggagctgcaacggtcgaggcggctgtcgtgaaggcagcgatgaccgcttcaaaggctggccggtacgccaaaaagcttgccctgccgtcggcggaggcagcttcccgcaaggacctccgtgcggacacggagtggctcctcctggtggccgacgcctacgcgcaccgggttgggcgtgtcgccgatgacagtcagccagagccggtcggagcctgatggcatgaccgacccgactcagcttgttacttaacctctggcttcgaacggtgcgtcgcacagggtcactcacctgggcattcgccggacaggcgggcggcccccgcatgagcatgcgttccgtcacagaaccgcactcatacgaaggccgcagaggtgagtctgctgcatcacgatgcccggcacgaggcgttcgacttcacgtcccactttcgggaggacctctacacatgtctgacccggcgcggtgacacgctgttcgagctgtgcgacgcgatgctctgcgaggacggcccggtgacctcgccggtcgatctgacgctgctggccgaacaccggcgtgggcacggcgcgttgtacgacgcgctcaaccagggccgcatcgacgcggtcaggctgcgcaaggcgctggccatgctgccgcagcccaaggccgccgacgggcgcctggtcctggccgtcgatgtctccgcgtggctgcgtcccgacgcgccgtgcagcccggaccggctgttctgtcatgtctccggacgctcgggacgctcctcggaccagttcatccccggctggccgtactcgttcgtcgccgcgctggagaccgctcggacgtcgtggtgccaactgctggacgcggtccggctcggccccgacgacgatgtcgccgaggtcaccgccgcccaggtccgccgtgttgtcactgacctgatcggccaaggacagtgggaggacggtgacgatgacatcctggtcgtcttcgacgccggctacgacgccccgcgcatggcctacctcctcgacagcctgcccgtcgaggtgctgggacggatgcgtgcggaccgtgtcatgcgacggccggcaccttcgcccaaggagtacgccgtgtcctatccccagggcgggcgaccgccgaagcacggcaaggagttccgcttcgccaggcccgatacgtggggcgatcctgacgcggagacggtgcaggtcaccgaccgctacggcgccgcgaaggcgatggcctgggaccgtatccagccccggctcaccacccgcagcgcgtggatcgaccatgacagcgaactccccatcatcgagggcaccctgatccgcctccaggtcgaccatctgcccggcggcggcgacccactgcccgtctggctgtggtcctccaagaccggcatgaccagcacagacgtcgacctgcggtggcaagcgttcttgaggcgcttcgatcttgaacatactttccgttttgtaaagcagacgctcggctggacccgtccaagactccgtactcccgaggccgcagaccggtggacgtggctcgtgatcgcggcgcatacccagctccggctcaccccggcccgcgttcgccgggggttcaggaacctccgcccccacctgcacagtccagcccgtgcacccaaaccctcaactcctggtttgaccaccaccgccccggcgttgttcagcagctgccgggtcgcggcggcggcctcgtccgggccgcggacgacagtgcccgctgcggggccccggccgcggtcgcgagcatcctgaacaccgtgtagttgttgacgagttcgccgccgcctgcccaaggagatcggcaccgagcagcttctccgagaggccgagggccgtggcgaggcggcgacggacgcggacggccacagcgcccacacttcctcgacggcccgagcgccgcacgagagtcaccggcgacctcgaatcccgccttgagtcctacggcgtatccgccgtcggcccgcccaatctccacaccgcacaacgccgcctgctgggccgaggctgacgggcggcagccagacgagcggaccgggttacaccacctgagggatctgacccggatccagggcgcagggtcgtttagcggatgcggaaataatccgtacggtcatctagtcagaatcacaccaccaggtgatccgttcagtggtgggtcgacgaagtcccgggcgagtttccgacgctctccccaacgcttcgcttacctgattacatgcactctgagctgcgcatattattgatcatttactcaggcggtggtgcgtaatcgcacgccctgtgattccgccggacgggctcccgtgcacctctgatgcaacagacggtaagcctcaagggtacgccagaaggtgatatacctctgggcgatgggggcgcggggatcgggggattcacgtatgcgcggttgtattcacttctggcacggtcatgcccgcaagtaatcaagcctgcgcaatttctatcactatctgatccactgttataccgcgccgcactaacccgcggcgccggggggagttcatcatgcgttgcatgctgttgaaagccggtgtgtgcggcagcgctgccgtgctcgcactcgtcacgtcgcccatcgtggcgagagcagccacgttggagccgaggatcgacctgaaggtgctcgtcgtggatgacgggggcccggccaccggggccatcaccgccgaactcgactcggcaggcaccccgtacaccagggtcaagctggccgacagcgggcggccgcagatcaacgccgccttcctcagcgataccgtcagcggccgtcctagggccaagtaccaggccgtcgtgctcccgaacgacaacccgttcggtgccggctccgccgagatggcgaccctggcgaccttcgagcagaccttcggcatccggcaggccgacgcctacacctacgccaggcccgaggtcgggctgaactacgcgcaatcgcctgggtacatcggctcgctcgacggcaccaccgcccaggtgacgtccgccgggaattccggatccttcggctacctcgccgggagcgtccccttcgaggacaacgcgcccgacgtgtccgagagctacggctatctggccgtgccgctcgcccaacagcaggccggggccacgttcaccagctatgtggacgccccgatcccgggcagttccgcgcgcggctcgctcgtcggcgagtacgcccacgaggggcgccgggaactggtcgtcaacttcgtctacaaccagtaccaggagcagtaccggctgctcagccggggcatcgtcgagtggctgacccagggcatccacctgggcgctgaccgcaactacttcgcggtccacgtcgacgatgtcctcctcggcgacgaccggtggaacacctcgctcaactgcacccccggagacgtggactgcaccccgggcgggggcgccacccccgacccgatccggatgacggcggcggacgcccagtacgccaagcagtggtccgccggtcacgggctcactctggacatggtgttcaacggcggcggcagcgaggactacaaggcggaacacggtggcgccgacccgacggcggaccagctcatcgccgacaagagcgccttccgctgggtcaaccacacctaccagcacccgttcctgggctgcgtccaggacgtcagcgtggtgccgtggaagtgctccaccgacgcgagcggaaagatccagtgggtcagccaggccgacatcacctcgcagatcacccagaaccgtacctgggcgggcggcaagggcctcgccctcgacaacacggaactggtcaccggtgagcactccgggatgaaggtgttgccgcagcagcccgacgacaaccccaacctggccccgtccctgaacgccaccggggtgaagtggctggccagcgacaattcccgagacccgcagcagcgccagatcggctccgccctcaccgcgccgcgcttcccgatgaacgtctactacaacgcgggccacgcgaccgaggaagtggacgagtacaacttcgtctacaccagcagggccaacggcggcagcggcatctgcgagggctcctcgaccaccacctgcctgagcgccccgctggacccccagaccggctacacgtcgtacatcgtcccgttggagagccgcatcgccctcgggcacgcgctttccaacgacccccggccggtgtacatgcaccagtcgaacctcgccgaggaccgcatcgcctacccggtgctggacaagatcctgggcgactacaccagcctctacgccgccaacaccccgctggtcaatctgcggatgaaggacatcgggaccgagctgaagtaccgcgccgcctgggccgccgcagtgaagaacaaccaggtcaccgcctaccggatcggcaacacggtcaccatcagctcgccgaacggcacccagaccagcgcgaccatgcccgccggcaccacccagaagcagctgatcggcagcaccgccttcggcgccgcctacgccgggcagctgtccggctggaccacccccggcacgctgcagacctcgatcaccctgcaactgaccacgcaggccacgcccgcggcccccaccggcaccggcaccggcaccggcaccgcgaaggtagccgcaccggcacccgcgctgcgtgtgcccagcggtgtggccagccctgtcccggcaggccccggcgacaccgcccgccgcaagcgctgaccgtgatcaacgggcacgacggcacgaccggcacgcgacgggcgcaaccgtcccaacgtgcacgacgggatacggggatagggggatacggggatttggcagtaaccgaccgcaccaggccagcattcggggacacaccgccatccggcacagccagggccatcgcggccatcaacaccggcacgacccgcgtcaccatgctcaccgagggcacctacccgcacagccacggcggagtgagtgtctggtgcgatcagcttgtccaaggcatgcccgacgtgaacttccagatactcgcggtcaccagtgacggccgcgagcccctcacctgggaaacgcccgcgcacgtcagcaaggtggtctccatacccacctggggaccgacgccgaccggccgcgcaccgcgcggccggcggctgcggggcttcctcgacacctacgaaatgttcctgctggccctcctcgatcccggccccggttctggctcctgtgccggccccagcacccttgagcgcttcgccgaagggctgtacggcctcgcggcacgagcccggtccggggaactgacggcggcgctgcgcaccgaggcagcgatacgcacactggccgccgtctggaaccgtccgcacgtacccacccacgccgcccggccgaccatgcacgacgtactgaccgcgaccgacctgctggaacacgccctgcgcccactggcggccgccccaccccggcacgggatcgcccacgccgtcagcggcggactggcggccctgcccggactgctggcccagcacctgcacggcacgcccctgctgctcaccgaacacggcgtctacctgcgtgagcgctacctcggttacggcgccggcggttaccactggccggtgaaggcgctgctgctcggcttcttccggctgctggcacaggagacctacgcccgcgccgcgctcataacgccgggaagccactacaaccgacgctgggaggaacgcggcggcaccgcacccgacaagatccgtaccgtctacaacggtgtggaccccggggcctttcctcccgccggtccggaaccggagatccccacgctggcctgggcggggcgggtcgatcccatcaaggacctggaaacgctgatccgggccttcgccctggtacgccgggagatgccccaggtgcggttgcggctgttcggcggcacacccagcggcggccaggcctaccgggaacgctgccaggctctcagccgggacctgggcatcgccgaagcggtggccttcgagggccgggtggaggacatccgcgacgcctacgcggcgggcaccgtggtcatgctctccagcatcagcgagggctttcccttcaccctcatcgaggccatgtcgtgcggccgggccaccgtctccaccgacgtcggcggggtccgcgaggccgtgggtgacgccggactcgtcgtaccgccgcgcgaaccggaggcgatggcacgggcagccctggaactgctgcgcgcgcccgcccgccgggcccggacgggcgaggccgcgcgactgagggtgatcgagcagttcacactccggcacaccatcgactccttccgggagatctacggcgcgctgggagcgggcgaggaccggacgcacctggccgaggacccggcgccgcgcgcccgacgggccggaggtgagtggtgaaccggccgggcgatgaccgaaccgtattactgcgcctgccgaccccgccgcagcggccgacctgggccgacgacccgctcgacgagctcgccgaacggctggcggacgtgtgcggggccgccgttcacccggacgagatcgccgcggtgctggagtccgacgggctgacgcaccaacagatcaccacccgctactcgcgacgggacctgttcgccatcgcggaggagctgtacacccgggtgccgcgccgattcccggaccccggaccgggacccgacccgtggcggaccagcccgtggcagtgcctgctgcgcgggatgctgttcggcctgccggggctggcctaccttctgggcgcaggactgctgcccggccgggtcaccgggctcgctgcctcggcactcgtggcctgggcctggaaccaggcactggcccaccgcgcctacgtacgactcgccgcgggcggccggcgggcagccgcgcggtgcctgctgctcggggccccggccggggtgacggcagcggcggcggccgcactggccgtctcgggggcgggtgccgccccggccttcgcggcgggagaggcgctctatctggcggcggccacggtgctgctcgttctgggacgcgagcagcacctgctgatcgcgctcgtaccgacggcggccggggcggcctgcataccgctgtggcaccccggcccggtgccggtcgccgtgctgctgctggccaccgtcgcagcggcggcgctgtcggcggtacgggagatcgtacggtcgctgcgcaccacaagctccgcggcaccgggcacgccccggctcaccgcctccgtcccgtacgggctgttcggcctggccggcggggcgctgacgctgatggccccggcggcgggcaggccggccgccgtcgtactgacgctgagcatgggcgtggccgagtggttgctctaccgctaccggagcctgaccctcaccgccctgcggcacagccggaccccgtggggcttccggctccgggcggtcggcgtgctcgccctgtgcctcaccgggtacctcgcggtgctcgccgccccggcgctggtcaccggggtgccgccgctgccgctgctcgccctcggcgcggcgctctgggtcgccctgctgctccaggcggccgggatcgcctggccgtccgccgtggcctgcctcgccgccgccgttgcggaggtggccctgtcaggcggggccaaccgggggccgggtctgctcagcccggcgaccgccgagttggcggcctgcggctgcgcgacggcagtgctgctggcggtcgcgtgcacccggatgggccggaccacggcccaccgctgaccagataccggtaacccgtagccccgtgacctcatgacgccctgcccctgcaacccagcacagcagtaaccgcccaataaccccgtgaccccacgcgggcctgaccgattcagattcagatcagaggagacagctccgtgacctcgtccgctcccgtaaccgtcgccgtcaccggtgccgagggattcatcggctcgcacctggtggaggcgctcatcgcatcaggacaccgggtacgcgccatggcgcagtacaactccttctcgtcgtacggctggttggagaccctgccgcaggacgtgatggacagtgtggaggtcgtactcggcgacgtacgcgacgccgggtcggtgcagcacctgctcaccggcaccgaggccgtgtaccacctggccgcgctgatcgcaatcccgtactcctaccaggcaccgcacagctacgtggccaccaatgtcaccgggacgctcaacgtgctggaagccgtacgccggctcggcatccccaggatggtgcacacctccaccagcgagacgtacggcaccgcgcagaccgtccccatcaccgaggaccacccgatcaacacccagtccccgtactccgcctccaaggcaggcggcgaccggctggccgacggctactacgccagcttcggcatcccggtggccaccctgcggccgttcaacaccttcgggccgcgccagtccatgcgggcagtgatcccgaccgtcatcgggcaggtggcggccggagagcggaccatcgccctgggcgacctgcggcccacccgggacttcatgttcgtcaaggacaccgcccaggcgttcctcgcggtgggcaccgctcccgccgaggcagtcgtcggcaggacgttcaacgccggtacgggcggtgagatttcggtcggcgacctggtgacgctggtcggcaagctcatgggggccgagcttgaggtccgcgaggacgcgcagcgcatccggcccgccgcgtccgaggtgatgaggctggtctgcgacgcctcccggctgcgcgccgcgactggctgggaaccggcccacagcctccaggaagggttggagcagaccgtccggttcttctccgacccggcgaacctggcccgctacaagactgccatctacaacgtctgacgacccgtctcaggccatcgaccaccgaccgacaacggagtccgccatgcacgcagtcattctggccggaggcaagggtgtccggctgcgcccgtacaccaccgccctgcccaagccgctcgtccccatcggcgatcagcacgccatcctggaaatcgtgatgcggcagctcgtcaactcgggattcaccagctgcaccatcgccatcggccacctcgggcacatcatccgcgcctacgtcggcaacggctcccaatggggtctgcgcgtcgactattcgaccgaggacagcccgctgggcaccatgggcccgctgctgaccatgctcgaccggctgccggagcacttcctggtcatgaacggcgacatcctcaccgacctggacttccgcgccgtcctgcgcagtcaccaggccgacagcgcgccactgaccatcgccacgtactgccgcaaggtcaggatcgacttcggcgtcctcaccaccgacggcaagcaggtcgtcggcttcaccgagaagccgaccctggactaccgggtctccatgggcgtctacgggctctcccggtccaccctggacggctacacccccggcctgccgctcggcttcgacgaactcgtcctcgacctgctccgcgacggcacgcctccggccgcccacgagttcgacggctactggctggacatcggccgcccggacgactacgaccgggcgaactccgagttcaccacccaccgcgacctgctgctgaagggagcgtgacctgatgcgcattctcgtcgcgggctccaccgggttcctgggccggcacatcacggagcacctgctcgccctgtccggcgtccgggtgctccgcgccggccgctccccgggcgccgacctacgggtcgacctcaccaccgccaccgtctccgctctcgccgccgacctgcacgcgctggccccggacgccgtcgtcaactgcgccggcgccgtcggaggcggcccgcttctgctggcggagaccaacgcccggggacccgccgtgctgtgcgaggccctgaccgcggccgacctcccggtacgcctggtccatctcggatccgccggcgagtacgggacgacccccgggcagccgctcggcgaggactccgccacctgtccgcagggcgcgtacggggccaccaaactggcgggttccctgaccgtcgccgaggccgcactggacgccgtcgtcctacgggtgttcaaccccctcgggccagactcgcccggcacaagcctgcccggccggctcgccgacgagctgctgcgcgccggaccggacggcacagtgcgggtcggtgacctgtccgcgtaccgcgacttcgtcgacgcacgggacgtggcccatgccgcagccctcgccaccacggcgcccggcccgctcccccgcatcctcaacatcgccggcggcagcgccacccaggtccgcaaggtcgcggaaggcctggcccggatcagcggattccatggccgaatcgacgagaacggcaccggttcccagcgctcgtcagccatctcctggcagcaggcggacatcacagctgccgccacagctctgggctggcaccccgaacgtaccctcgacacctcgctcgccgacctgtggacctcgcgcaccggcacgcccccgaccccggcatgacacacggccgactgcttgttccgctgtacgtccaccccgctgtggaccctgcggcgtggcaggccctgacgcgagtcccgtcgcggctgtacggtgtcgtcctcaacgttgccgacggccccggcgcgacccgcgacccggccttcgccgccgccgccggggccctgcgtgcggcaggcatacgcgtgctcggatacctcgacaccgcctacggcacccgtccccaccagacggtgctcaccgagctgcgccaccacgtcagctggtacggaaccgacggcgtctttctcgatcaggccagtgccgaagctggcctgctgccgtactaccgcgtgctgggcgacgaggcccgcgaccacggcgtcggcaccgtcgcgctcaacccgggaatgcaccctgattccggctacgcctccatcgccgatctgttggtcaccttcgaagggaactggcagacctacctcacctcagccgcgcccttctggaccgcggcgcacccgtcggcccgcttctgccatctgatccacggcgtccccgacggcctgtgcgacctcgccgcccgcaccgcacggatccgccgagccggcgtccactgcgcggtaccgggtgagggcgcgaacccctgggccgccctgccccccgccgtgaggaggggaaccacatgaggttcgcaacccgcccgccactcctgctgtcagccgtgttgctgctgttcacggaactgctcggggctgctcaccgggtgcctcaacggtccggcgtcaccgagggagcggaacgagggccctggccgggccgcgccaactgtgtgtgcggcctggccgcctgcgatcgggaacagcggctcacccgcgagctgggcggcgtcgacccggtcgagttctgcgccgcgccggccaaggcggcgcccgtcaccccaccggttcgtcaaggaagtgctgcgaatgtggagcccaccgctcattctggtgcggcgcgcacgggcctcgttcgacctcggcaccacccggctggagaaagcgcagaactacctggtcagcccgcacatgatccaccgcgatcaccgctactggcagcagcccgataccttcgaccccgaccgcttcctgcccggggtaccgcacggaccgaccgacagatcgtgttacgtaccgttcgggtgggcgccgaagaagtgcatcggtaacgatatcggcaccactcagctgatgggcctgtgctatctgatctgcacgcgctaccgcctcagcgtcccgaactccgacacgctccccatggcctgccgtttcgcccctgtaccgcagcgattcaacggacgcctcgccctggcctggaactgagcattgacgctcaggccgaacccatgcaccccatgcgccgtggtaccggtaactcccttcaccccaggcagacacccagtgccccaggcagccgccggtccgtctcgcgtctgctgcagcttgtcccgactgcttacccagcggtatggctcgtgggcatcagccgcgcatacgcgacacctcaacatgcgggcttaccagtctcacacccgtacgcctgcgggaaggagtcggccccatgagtcgcagggaagtgcctcacggggacggtaggggcgcggcggtgtccgggggtgggccgaggaagctgggtagtgggcaggcccagtccaggctcctgttgtgcaccgccttgtagaactcgccccagtccgatgggcatgtccccgacggcgtcaacgcgggcgcggggaccgtggtgccgggggtgctgtcggccggttgggcgaccggatggcactcgaccgtgtacgaaccgcccgtgcagtcgacggtcgcttcgccaccgcacgctgatacaccgacgatcagcaacgccgtcaccacgaccgtcgcggtgcaccctcgttccgtggatgacgcagaccgactcctcatgaccttctgtccccctcttctcctgcccctggcgcggacccttcccgagcaggccaccgcatgcctgaagtcaataggggaattgcgagcaggagggggctccttcgaccgcgtcggggtgagcggatacatcctgcagaaaggggagttcggttcgccttcggcaatgcaggttcccttactcggcggtgacacatcatgaccggtacacatctgcaccacaggccctgaacgtgctggataccgggtggctcccgacgttatgccgccttcctgggccagcgtgtcccggcctgcttgacgatacggtcgccgacggcgaacaaggcgtaaacgtcgtctttcacctgcaaggtgaactgccgaccgtcgtcagcacgtagtcggtgcgcatgccggtggtcagcgtgacgcgatggaccgaaagggcgatcacctcaccggcgaactggctgtccatctgctggttcacttgtcccgcgaaggtccacaggagcagaacgatgggcagcaaacccagtaccaagaagatccacataactcccccgcctgccgcccgcggcggggacgaccgccgcgtttgttgagcgtaacgccgatatgcagcgccgcccagggtggcaacggctgtcaggcgcgtgccctctgcgaagtatccgtgggctgcgtccagggaagtggtgtacgggttcgacctgatccgggggtttgctccggcttctggctgatgcccgcatagatggctccgcccgaaaggcggtgccgtcgacgacggcgtcgtggacggccaggagtgcgggccggtgcccgtcgaggtcgccgaaggcgtgctgggcatcgagggcgccgtcccacagcttccccgaggccttgtcctccagggcggaccaggcgtgataccgatgacgttgatggccgtcaccgcggcgtacgcggtcggcgagtacagcgacggcgcggccagtacgagcgccgagccgacggacagccatacggcggcggcgggcgtcttggtgcgagggctgacgcggcgccaggtggcagcgaacgggatcgctccgtcgcgggagaaggcgaacaccatgcgggacgcggcggcggtctcggcgctgccgctgaagagttgggccacgatcacgatgagcatcagggctttcgctccgtcggcccccaggacgtcgaggaagatctgagcgggcggcacaccggtcgagctgctctgggttccggcatagtcctggatggcggaggtgagaccggccagcaggatgaagccggcgatccaggagacccagatggagcggacgatgccgcggggggccgatatctgggcctgggtggtctcctccgacaggtgcgaggaggcgtcgtagccgcagaacgtgtactgcgccaacagtagccccagagccgttacgtacaacccgttgtgagctgcaccgagtttcgtagcggccggtttgcgtggtttcaggcggcgttcattgctgcctgagatcggtagtgccgggtctcgaattcctcggggggggaggcagtcgagtgctgagtgcaggcgctcggtgttgtaccagccgacccattgaacgacggaacgttcgacctggtcagcgtctcgccagggcccttggtgctcgatcagctcggccttgaaggaaccattgagggcctcggccatcgcgttgacgctcctatagttgtcaacttgccgcggaggccctccgtggggctggccgaagcaggtggtagacctcgcggatgacgtagcgcttgaggcaccggatgatctcgcgtttcgtcttgccctcggcggtggggcgggcgacgtagccgatcgtggggtggtggaaccgcatgcggacgatgacggttcggtagatcgcggcgttgagctggcggtggccaccgtggttgatgcgatgcctgccggcggtcatgccggagccggtgggcacgggagcgatgcccgcgagcttggcgagggcggcctcggacttgatccgctcggggttgtcgccggtcacgacgaggatctccgcggctgtgtccacgccgataccgaagggctcgagcagttgcggggcgacccgctggaccaggtcgccgatcatcttcgtcagttccttggcctcggcatccaggtactgccaccgcctggcgagcgtccgcagggtgtgccgaagggcgtcctcgggtccttccagacggcgaggacgcagagctgccagctgcctggccaggctgatctgtgtcttgccgacagtctcccgacgcagggcgtccgaggcgtggacgagtatcgccttgatggtgaccatcgccgtcgcacgctgttcaacggcctggtcatgggcgatcttgagttggcggatcatctcggcctcgccgtcggcggtcttcggcgtggcggtcgcgaacccggccagcacggcgcgggcggcgttctcggcgtccagggtgtcggactttccgttcatgcgccgcagccgccggtccgggcgtccggcctcgcccaccttgtgaccggccctgcgcaggaatgaggtcaacgtggcgccgtaggagccggtgccctcgatcccgaaggccacaacgtcaccgaacgagcctgcccagtccgccagttgctggaagccgccggtgtcggtgggaatcgtgagggtggccaggattccgccgattgtgtccatcaccgctgcgacgtgcacgtgtttgtgtgtgtcgacgccgatcacgacgtgcccggacctgggttgctcactggtccttgcggagttggcccagctcggcccgttcggcggtggtcagcagatcaggccggtcacccttgtctgcctcggcctggcagacccatccgcgcagggcctccttgtggatgcccaggtccttcgcgacatgagcgaccggacggccggaggtctggacttcgcggacggctagctcacgcagctcatcagggtacgtccaagaccacggagttaaggccgatccggggttgtcaacgggatccgggattttcggggaagcgcaggtcatggcaacggggctcctggtagagcgaggaagccgaccaaggtcttcccactcgaaggagccccgttgcccgttcagtgttccaccgtcacgctcacgtcgtccatcaccgtcgccgacggcatcttcgctccggggcatcttggcgagctgacccagcagttacccttcgaactcgtcgatgacgtgctggaacgcgccggcggcgcccagcacaggctgcggctgctgccgtcgagggtgggcgtgtacttcgtgctggcactggccctcttcccgcagctggggtacgtgcgcgtgtgggacaagctcaccgccgggctgcgcgggattcttcaccggcgcccttcggagaaggcgttgcgggaggttcgccggaggctgggcgtcgcgccgcttcggttgctgttcgaaacgctggccggccctgtggcacagccgatcacacccggggtgcgataccggtgctggcgcacggtcgccttcgacgggtgcagctccaccaaggcccctgaccggccgcgagtctgtgcgtggctgggcaagcacaagcaccgctacggcaccgacggatacccaatgctgaagatcatggtgctgtgcgagaccgggactcgggccctgctcggcgcggtcttcggaccgacgccagagaaggagaccggctacgccgagcaactgctaccgctgctggacggcggcatgctgctgctcaacgaccggggcttcgactccgacgacttcctcgcgaaggctgcggccaccggcgcacagctgctggtgcggctcaagggaacccggacccccgcccgctgggcgctactgccggacgggtcgttcctgaccaggatcaacgggacccggctgagggtcatcgacgcgcacatcgcggtgacgaccgccaaagggctgcggctggaaggccactaccggctggccaccacgctgaccgatcaccgccgctaccccgccgtcgagctggtggagctctaccacgagcgatgggagatcgaatcggcgttctactcgctccgccacactttgcagtgcggcctggtgctgcgctcccaggacgtggccgggatccagcaggagctatgggctcatctgaccgtctaccaggcactgcgccgggcgatggtcgaggccgtcgagacgcttcccggcacggatccggacagggcttccttcaccgtcgccctggagaccgccaaggaacagctcatcaccgcggccaatgtgctgccagacgccggaccagggcgcatcacatcggccctgctgcacgatctactcccaccccgccaggcccgcgtcaacccgcgccgcgtcaagtgcccgatctcccgctacgccgccccgcccgaccaggcccaagccctcggggcctccaggatcaccagcatcgccgtcaccgtgcactcgtccgccggcaccggctctgacgggcgtcgcgaccacacgctgcaactcctgcgcaccaaccctctccgcacctggcgcgcatgcgaaatcgcccgcggtatcggactggacgacgctcgaggactacgcgcggaactggggcgctgggtccgcgaaggaatccttcgccgcaccgggcgaggcatctacaccctcgaacccgagtggatcacacccgacctccaccacccctcggtcccgccccatttgacaaccgcggatcggccttaactccgtggtcttggagtacttccggggagcaggcatcggacctgtgttctcccatctgccgaggcgatcatgcctggcttcagggccgctacaaaatccggttcagctcactcgacgcgttccgctggctgcaccgctacaacacccgacgccgtcactcccgcctcggacaacgcagcccggtcgcctacgaaaccgtgtcgcgaacaccaccaactacgctggcaccagccgcataacccgtgtccagaatccggggtcaaggtccatccactgcgggcggcgtcgacaccgtgtgtgggcacaaggacggtggccgccgcaaccgggtttgaaccgggcacacagacaacgccatgatggggccgttcgagcagccccggtgcggtgggagcaaacagatgcggctagacgggaagacggccccgtccgatctccagctgaagatcgtgctgcacggcacgagaccgcccctgtggcggcgcctcttgctgccgtccgacacctcgctcgggacgctgcacgacgccatccaggtcgccttcggatggcacggtggccatctgcatctcttcaccgacgagttcggccgggggtacggcgatgcggcccggctcaccgacatcgatctcggcttcggccgcggggtcggcgacgaggacaccaccgcgctcggcgacgtgctggccgaggagggagcacggctgcgctacgtctacgacttcggcgacgactgggagcatgggatcacgctggagaagacactgccgcgcccggtcggcgcggagcggacggtgcgctgcgtcggcgggcgtcgcgccgacgcaccggccgaggacatcggcggcgtgtcgggtctggccgaggtgctggggttcctcgacaccccggacggggccttcgatggcccgtacggtgaacttgtcgccgagctgcgggcggcgggttacgacccggcggccttcgaccgggacgcgatcaccgctcggctggccgaggtgacgccggacacggtgtccggtaaagcgaagccgccggccggtgatcggtccgggcgcggcggtgtccgtcggctgaccgccgaggacgtggcgttgtgtacctgcgggcagtgcggggtgggcgatccggtcgatgccggagtcgacgggccggccgaggatgtgcctgtgctgcgcccggtgaccctggctccgcaggaggaccttgtcgctgccgtgcggggtgttccgctcttcgacgcggcgctgcggctcgccgcctggtgccacgagggacggcaggtcaccgccggccgggtgctgcgtcccgcgctcgctcgtgaggccgtcgaggagctccagttgtggaagctggcaggccacgactcgccgtacgccgatgccgtcgcgcggtctcgtgcgttgaaatccctgcgcagcgccaaggacgtggccgttctcgatgatccgtggtggctcgccgtggatggcgagatgatcacgatcagaggaggccgcgcgtcgggcggcgcggcgaccgacttcaccggtgaggaccttctggagttctgggccgccacgatgggcgatctgctggaggagatcggtgagacgggggtgctggacgggtggcacggtgagctgggcgagctgacggccgagatcgccgacggactggtcggcctcctgtacgacgccccggacgacgcctgggtggatggcgacgacctgcgtgcgaaggcccgtgagaggggcgagaacgggccggagttcgatctcttccgggcgctgttcgcggcgtccttccgggcactgggggaagggctcgccctgctgggtgcggtggagtacgagtccggtgacggcgacgattcggccgaggagactctgcgcacactcctgaacgccgtggtcggacagaagccgggcggttcaggaaccttgccgtcggcgtcggactggtcgcgggacgacaggcgcggggaccgcatgcggctcacccccctcggtcgctacgggctccgcgcctacctgatggagtgcggtgtgcccgcccccctgctcggtgagtacgccgaagcggacgccggcgctctgctccaagggctcctgggctactcccccgaggagctgcgccgggaggtcgaagggtggctggaacaccgcacggcggcagatgccgcggtagggctgctcgacgcatgcgcgggagccgaccacgaggcagcggcgaagcgcgccgtggcccaactggtgctggccgatctcgacgacccccgggcactgcgcgtgctgcgcaaggcagcggactccgacgtcgaggggtgccgacaggtggccaccgcgaccctgggcgcgcaccttgagggagaagcgcccgtggacccggcacgggcggaggaggccggactgtggctgctcatcgacgggttgtccatcctcgccggtgcaggggagaccgaggagctggtccggggcttcctggagaacgggaacacggcgccggaggcgctcgaacagcgggtggacgagctgtggcgagtggagcacccagccaccgcccaagtgctcgccgaactgggtgagggtttgcgcggcgtagacaagcggctagccaagcgtatgcgtaccgcggcgaacaaggcccaatcccgccggtgacagcagggtcggaacctgctggtggacgaaggcgcggtgaagaccgcctggacgacggtgaggcgaagagtggcacgagtccgggcatgaggagcgtgccgccattggccgcaccggaatcggctgcctgggcgcggagtctgctcaactacggctgggcggcggtgttcctgcccggtgagcccgcccgcctcggccggttgctgctgtggcgacccgccggggcagccgccgccgagggcatggcacccacggacatcgagaccgaggcggcggagctcgtgctgccgcacggccgctcggtcaggcggcgcaaggtggagggctacgcgctgcccgtcgccctcgccgttgccgcgctgtccggggcacagccgccgcatccgtccgcctccgcctggcaggccgccgcccgcttcgcgctccggctgctcgccgatggtcgtctccacccggccctcacccccgccggctacgacacctggcaggcgggccccttcaccgccgcccagcgtcggacgctggacgccctcgccggcgcgttcccgccccacgcccactgcctgccggaaccgggtccgaccccgctgcggatcaccaaaccgagcgcgctggtacgccggttctgcgacgcggtcgccgacgaactggtccgcacccccgccgctccgctcgcgatgggagccctgccgtacgcctggcgcgagacgcgtaccgtgcccgtcctgcacgagtgggccgaggagaccgccgccgcgttcaccgccgacgtcagggtctcgctgcgggtcgacgtgcccgagggacgccgtcggcagttccgggccgtcctccagttgcacaccgttgcggatccggcgctcgtcgtggaggccgcacagttgtggaacgagccggccgagaccgagcatctgctcggcccgcgcgccgaaatcgaaacgctgctcgcactgcgccgcggcgcccacgcctggccaccgctcgaccggctgctgagggacgccgctccggaccagctgcggctgaccgacgacgaggcgttcgacctcctgggcgacgccaccgacaggctgcgcgccgccggtatcgacgtgcactggccgcgcgagctcgtcaaggcactcactgcgaccgcggagatcgggcaacgctccgcgcccggctccagcgcgggcggcatgctcgacgccaacaccctcgtcgacttccgctggcggctctcgctcggcggcgacccgctcaccgaggccgagatggacgccctcgccgagacgcgccgccccctcgtccggctgcgcgaccagtgggtcgtcgccgacccgaagctggtggcccgcgccaggcgccgacggatggaaccgctcactcccatggaggggctgggcgccgcgctgaccggcgagatggagcgggacggggagacttttcgctgcgcggcggtgggagcactcggcgacctcgtcgcccgtatccgcgaccccgaatcccgcacccccgccccgcagcccaccgcactgaaggccacgctgcgcgactaccaaaaacggggcctcgcctggctggccgagatgtgtgagctcggtctcggcggctgtctcgccgacgacatgggcctgggcaagaccatcaccctgctcgcgctacacctgcaccgccagaccgaaccggccactgcgggccccacgctcgtcgtctgccccgcctcgctgctcggcaactggcagcgtgaggcagcccggttcgcgccggccacgccggtgcgccgctaccacggcggcgaccgccacctgaaggacctggctgggaacgagatcgtcctggtcacctacggagtgctgcgccgcgaccgggagaccctcgctgagaacgcctggtcgctgatcgccgccgacgaggcccagcacgtcaagaacccctacgccgtcaccgcccgcgagctgcgcgccctgcccggccgcgcccgcgtcgccctcaccggcacccccgtggagaacaacctctccgaactgtgggcgctcctcgactggaccacccccggactcctcggcccgctcaccgccttccgcgaccgccacgcccgtgcgatcgagtcgggcgaggacccgcaggccgccgaacggctgtcccgtctcgtccgcccgttcctgctgcgccgcaggaagtccgacccgggcatcgcgcccgaactccccgccaagaccgagaccgaccgcgtcgtgccgctgaccgccgagcaggcaagcctgtacgaggcggtggtccgcgagaccatggcgaagatcgccgaagccgagggcatcgcccgccgcggcctggtcctgaagctcctcacggcgctgaagcagatctgcaaccaccccgcccagtatttgaaagagcacagcctgcgccagtccacaccgctgaacggccgctccggcaaactcgacctcctcgacgaactcgtcgacaccatcaccgccgaaggcgagtcggtgctggtcttcacccagtacaagcagatggcgaccctcctggagaagcacctcgccgagcgcggcgtccccaccctcttcctgcacggcggcacgcccgtcaccgcgcgcgaggagatggtggaccgcttccagcgcggcgaggtgccggtgttcctgctctccctgaaggccgcgggcaccggactcaacctcacccgcgccacccacgtcgtgcactacgaccgctggtggaacccggccgtcgaggaccaggccaccgaccgcgcctaccgcatcggccaggacaagcccgtacaggtccacaagctcatcgccgagggcaccgtggaggacaaggtggcgaagctgctggaagccaagcgggcgctcgccgacgccgtcgtcggctccggcgaggccgccctgaccgaactgtccgacgccgacctcgccgaactcgtcgccctgggaaggcagtcatgagtccctcgatccccggtccgcgccgcgcgcccgcccgcggcaggcgcgccttcgccgcgacctggtggggacaggcgtgggtgacggccctggaggactccaccctggactcggggcgcctgtcccgcggacgcacctacgcccgccagggtatggtcggcccgaccaccgtcgcccccggccaggtcaaggccccagtccagggcagccgcccgcgcccctaccgctgctcggtccacctgtccgtcctcaccgacacccagtgggacaccctgctcgacaccatcgcggcccgcgccgggcacctcgccgcgctcctcggcggcgagatgcccggcgaactcgtcgacgacgcccgccgggcaggcgtccccctgctgccgcagtccaccgagctcgacccggactgctcctgccccgactggggatacccctgcaagcacgccgccgcgctctgctacgccatcgcagccaccatcgacgccgacccgttcgtgctgttcgccctgcgtggccgcgaccgtgaggaagtcatcacccagctgcgcgcccgccgtacggccgcccaggcgacctccaccccaccggccccggccggcctcccggccgccggcgcctacacggcctggggcgccctggccgaccagcccccgtccctccccgaacttcccgaaccggcaccccacaccgccgcactgcccgccgccccgccgcccggcaccggactgtccgccgcggacctcgaacgcctcatggcggacaccgccgcacgcgccgcccggctactcacgggcgacaccaccagcctgcacctgtcccagcatgaggacgcggcgcggatcgcctcgagcaactgcggacccgagtggttccaccgcctcatccagaacaccggtgccaaaccggccgcgttcgcccgcctcacccgcgcctggcggtatggcggcccaaccggcatcaccgtcgccgaacagccacgcactcccgacccgaccgcgatgacagccgcccgcaccgccctgaccgagacgctcaccgaaatgaccacgcccccggtcgccctcagggcctggcgcaaccgcctcaccctcgccgaccacggcatccagctgcgcctgggccccgacacccgttggtacccctacctccaggatgacgacggcgactggtggccggcagcgccggccgaccccgacccggtcacggcactcacctccgtctggcagcagaccgagaggtgacacgtacgacagacccgtgaacccgctggctcagcccacatgtcacatctcccgacttccgtcacccgtaccgttcgccaaggagctcatgccccttgacgacggagcagaaggttgcaggttcgaatcccgccgagtgcacagcagaccagaggccccgaggagcgatccttggggcctctggcttatgtcttaagccagtgtttgacggcaaccggttcgtgcgctgttcgatgggctcctccaggagtgactggttgatccgggagggtcagtcaaggcccaggagtggcaaactcctgctccatggctgacttggcaacgcaagtacttcccgtggcctccgcacttgcgggagtggcgctgacccttgcaggcaacatgtacctggagcgcagcaagtggcgccggagtcggcataccgagcaagaggcccggtcgctgcaggcgtatgccgatcttctgcaaggggcgacagacatcgcacgcactctccgacaggctgccgaacagctggaagaggggcacaacgtcgacatgcaagcgatcgccgcggtcatagatgaccacataggccaactgcggcgacagggcacaatcgtccggttggtggggccgcgtagcgccttcgacctggtcaaggggctggaggaccaggtcgcccccatctaccgactgctgattgaggtcgggcgctcgggtgatggatcggctctggtgcagcctgcccggcggttgatgcggacccgggatgagatcacggatcacttgcgcatggccggaggtcttacctgagccgtgttcactgggcagcagctggcgaggctgggggtgtagatcagacggctaccaggacaccggccgcgccgtcgtcatcgtccggatcgttgccgtcacccctcagggcatccccgacgcgatcgaacgccgagcgctgcgagtcgagccggacgaaggtgtagatgtccgtggtcacgcggatcgagctgtggccgaggacttccatgatcatgcgggcgtcggcaccctgttcgtggaggagtgaggcacaggtgtggcgcaggtcgtggaagcggaccttgcggacgcccgcgcggacgcacagcacctcgaaggagcggttcaggttgcgcggcacgatgggggtcccgttcttggtggtgaagacgaggccctgaaccgtccccttccagttggcaccagccgctttccggtcggcgatctgccgcgcgcactggccacggagcgcggtcacgcactcggccggcagggctacgcggcgggccgagcgctgagtcttcggcgcgacgatcagcagttcgccaccgacccgctgtagggcctgccggacggtcaggaccccttcgtgaagatccacgacgcagccgagtacctcacccgccgcagaccgatgcggaccgcaagtttggacgtgggcccgccgggggcggtgcactgtgtgcggatcagcgggcgattgagatcgcgaagggtgtgaatccggtggccccgatgacgtgcgggacgaagaggattgcggcctccgtggcgcgggcggtctggatgccgccgagatcagcgatccactccttgtgccagccgaggtcggtgagcagttcgcggacggtctgcttggcctgggggtcctcgccggagaggaacgcggtgggtgtctgggtgagcgtggccggtgctgtcatcaccgggaagagcatggtgttgagtgtcttgacgacgcgggtttcggggagtgcttcctggaggtgctcggcgaggcttgagccggggtagatcaggtcggcgggcaggccgtccggtccgtcgttggtggcgttggagacgtcgacgaggatcttgtcgcgcagttcgtcgcgcagggcggcgagccggtccagcgagccggcgcccggggtggcgttgatgacgatctgggctgtgcgggcagtgtcggcggcggcgcccggcgtgcggtccgcgacggtcacctcatgccctgcccgggtgagggctgtggccaggttgccgccgacacggccgtttccgagaactgcgatcgtggtcatgatgatgtggtccttccgtcggtgcaggtggtggtgcgcggtcagtgggaaagggtggcgacggcctcggcgtggatgccgggcgcggcggccaggaagctctcgctctgcggggtccaggggcggccctgggcgtcggagatctgtccgccggcctcggtgacgaggagcgctccgggcagcaggtccgcgcgggcgccggcgaactgccagaaggcgtcgatccggccggcggccacgttcaccaggtgcaaggtcgcgggcacggcggtgcggacgacaagcgcgtcgaagagcatcgcggtgatcgaagagccgacgcgccgcacgaccttctcgtcctcgtccggccgggcctggctggtggccacgatgctcaggccgaggtctgcggccggggagacgtgcagcggccggccgtcgacgtgggcgcccgcgccggtgagcgcggtgtaggtctcgccggtcaacggcaggtggaccgcggtgagcaccggctggttctcacgcacgagggtggcggtcaccgcccattccggcagggcgtgcaggtggttgacgttgccttcggccggatccacgacccaccattcgccgggcggcagcgccccgccgtccagctcgtcctccacccagccggcgtccgggcgcaggctcgtgaggcggggacgcaggatgtcgagggccgtgtcgtcgttggcggccagcgcgcgcatcagctcttcacggctctggtaacggaccacctcgccgaagcgctcgcgcagcgccgaaccggccgcacgcacggcgttcgcggtctgggcgagcaggtcggcgtcggaggcggcgactgcggtggtctgaagcgtttcggacatggtggtactcccgtgtgagagggggagggtgaggtcggtcgggccggactgtgcggtccgtcctgcgctttcgtctcaacggtatgcagccccgccattaacatcaaatgcatgtcaagcacggctaggattacccgcatgcaattggatttgaatttgctcgccgcgctcgacgcgctgctggaggagggcagtgtggccggggcggcggcgcgcctgcacgtcaccgcccccgcgatgagccggagtctgggccgcatccggcgcacgaccggggatcagatcctggtgcgcaccggccgcacgatgaccccgacgccgtatgcgatcgccgtccgggaacaggtgcacgagctgctgcaccaggtccagggggtgctggcaccaagccgtgaactcgatctggcaacgttggagcgcactttcacactccgctggcacgattccctggtcgccttgagcggccccgcactgctcgcggccgtgcgcggacaggcgccgggcgtgcgattgcgcttcgtcgcggaatcgagcatcgacacccccgagttgcggcgcggcgaggtcgacctcgaggcgaacgccaaccgcccgagcgcaccggacatccgtgccgagaacgtgggcgagacccgcctcgtcatcatcgtgaggcaggggcaccccctcacccgcgtcaaaaccgtcaccgcacagcggtacgccgccgccgaccacgtcaccgtctcgcgacgtggaaacctcagcaatgccctcgacgactccctcgcgcggctcggcctcactcgccgcgtggtggcgaccgcgcccacggaagcggccgcgctggagttcgcgcgcggctccgatctcctgatcagcgtccccgaagccaccacgcggtcagcggtcgccgacctcggcctggtcgtgctccccctccccctcgaactgccgtcggcgccgatatacctgtcgtggcatcagcgctacgacaccgaccacgcccacacctggctgcgcgggctggcgcgaaccgcgctggccatgggcggagcgtcgtagtcggcgccgtccggccccttcacccatacgccacgcgaccaccttgatgccgcacggccggccgccgtgcggacccgcatcagatcacccgccccggcggggggacacgaccaacctgaacgcggtcgcgaagcccgagcttgccaagaatccaggacccgaacgtcttgggggtctcctggctgcctccaccccaatgctgctggcccgctcccgccacgcctccgtccgctccctggagaggtacgcacgccccagcgtcggagtggtcgctcagcacgtcgccgaacgcggcggcgatctgcttgaccgtcagcagcgccttgtccctgcgggtgctggccgtggggggcggccagaccgacgcctgcggcccacgatcgcggatctgtggggggtgtcggcgtgaccctcggagatctgggcgagcagctggccctggtcctggtcaagcgccgctgcatacaccacctcagggcgtggccgacgcgcgacggccaaaggcctgcacgcgggaggtggccacccgttcgtgcgcaccagagacctaccgtgtgccttccccacagtcggtgggagaggcacttagattccagagtatgactacagagccgcagcgcttcacgatcttgctggttcccgaacacgtcgaggacggagacggcgtctccacggaagactcggcggtgcgatcggcagtcgtcgaagcgaccggcgagacgggtgcgacgggttacccccgctacgcgggggacgggatcgtggccgacatcgacccccgcacacgcacggtcgaggcggtgctggtcgatggtgcagagctggactacgggctcaacgccacggtcgcttcctgaccgcccaggttcgcccgaaactgccgtgagacgagggccgttgcctgttgctccgggcgcttctcggaccggatccgaggagtctccgtttgcatgcggcctgtacgtcagcgccgtgccgacacagggttcagtgccgagacgagatcggtgccgagcggcggcatcgagtggccccgctcccggaagacaccgactgcgctgtctgcgcacacgactgggcccgcgcgaccgaagtgggtgccgtcgatcgcgacgacgagcattccggcccagcgggccccggccgtgcggaccgccgaggcagggccgcgcagaagatcgaacagagcgcgcaccgggcgcaccccgagccgggtccgtgcgtcccacaacgcggttccgctgatcgtcacaaccagtatcgagtccagcgcggcggtgagcttgcgccagacggcgagatagccgcactcctcgaacaagacggccgccagtaacaggtagaccacgacgcgagcgggagtttccgcaaccggcgctgggtcgcgccgctttcggccaggacggcatcgaccatctcaaagggaacgatgcgggtgagctcacccagatgcccaggcgcgaacaggccgctggctaccgtgatttcacgcgtgatgacacactggcacgacagcggagcctccggttgtgtgaacggcttgtcttggtcgaccggtagtgcccggctaactgctggggtggactcctccgtccagacacccctatggggtggcagagacgcgtgactcacgccccgcagtcccacacgctctcgccacgggtggcgatgttgtgggaagcatcccggtcagtgtgggcaacgaccccgcaccctcggcagatgaaaagcccctggtcgacacggtttcgcttgtccctgcgggagttcaacggcgaacgcgatcacgtccacctgctcgtgcactacccgcccaaggtcgccatctcccgactcgtaggctccctcaagggtgtctccgcccgccgcctgcggcaggagttccccaaccacatccgcaagtacccgtggggtgagcacttctggtcaccgtcctatttcgccgcctcgtgcgggggcgccccgctctccctcatcaaggagtacatcaacaaccagaaacgtcccagcttaggtcaacagcgcagacccgtggacccgcgcgggtcagagcagcgtcaaaaagcgcttcctcccgggcgtgaacgctcggggttccgcgctagatcatgctgaatgacgtcactgggtgacgcgcccgcgcggcggaccgccaggagcgccgcgccgatgtccgccgccgctcggggatcggacagggagcggcccgccagctcctcgacgcggcgcagccggtagcggacggtgttggggtggacgaagaggctccgcgccgcgtccgtggcggagccggcggcggcgtaccagtgctccagggtctccaggagacgggcacgctccgctgccgggagatcgagcaggggctggaggaccacctccacgaggtgcgccgcctcggccggggcggcggcgacgaccatggccagcgggttgtcgtcgaaccgcgcgacgccggggccggtgccctggaggccggccagagccagacgggcgaagcgcagagcctggggggtgtcccccagcgagtgaaagcacgggctgacaccgacgcgggcgcccgcgcggcgcagaatgctcagacacgtgctctccgccgtcgccgtgggcagggcggccagaccgatctgttggtcgggcagcagccgccaggcgaaggggatctgggcctgacgcagcgccgcttccgtccccgccaacggctcctcgccgggagcgtcggccgccgcagcggcgaccacgtacggtccgcggtcgggcagacccagctcgcgggcggcctcccacagcgtgcggtcggcgatgactccggtgaacagtgcctccaccagcgccgagcggcgcgcctgacgtcgcgaggtcagctcggcggtcgtctcccggtaagccgccgccaccgcctccgcgtagcggccgaacagggcccagatctccgcggactgggacaccagttgggcgtcggtgacctcggggcggttgcgtgcctcggcgaggatgtccgtccacaggaactcgaagccgatccggtacgcgtgcagcgtgtccgccagcggcacgccctgctcggcgcggaggcgaccggtctcccgggccgggctcgggtcctgcgcgcccgcgcggccgagctggtacaggagcaggtccgcgttggcggtgcacgagcggcgcagcgagtcgaaggggatcagcgacgcgtccttgtaggcatcgacgtccgagcggatgcgctgcgccatccgctcgcccagttccggcagcctcgcctgaagtgccgagaccacacctgagaggtccattcccgcagcgtaacgcccctgttttgtcctggggaacaatcagggagggcagacgctgtcatgcaccccataggccctcgccacggacatctgcacgatgtcgtcaacgtgaacagcggatttcgacggcgacgttcgtggaggcggtcatggccaatctggcggagttcctggtggagacggcacggcggcagccggaacgccccgcgctgcgactggggggccaggtcaccagctacgcggagctcgaccaacgcagcgcccgcgccgccgcgctgctgcgggccgagggcgtacgaccgggagaccgggtcgctctgatgctgcccaacgttcccgagttcgtcgtcctgtactacggcgtgctgcgtgccggagcggtcgtcgtgccgatgaatccgctgctgaagacccgggagaccgaataccacctgcgcgactcgggcgcgcagatgctcttcgagtggcaccaggcgccgggcgagggcgcgcagggcgcagccgccgccggagtgcggcacatggccgtcgagcctgccgccttcgcgggcctgctggccggccacgcgccgctgccggaggtgagcgagccggacagcgaggacgtggccgtgctgctgtacacctccggcaccaccggccgtcccaagggcgccatgctcacccacaccgggctgcgacacaacaccgaggtcaacgcggtcgatgtgcagcggatgacggcggaggacgtggtcgtgggctgtctgccgctgttccacatcttcggccagatctgcgcgatgagcgtgaccgtccgcgccggtgcctcgctcaccctgatcccccggttcgacccgcagaccgtgctggacgccatcgcccgcgaccgggcgacgatcttcgagggcgtaccgaccatgtacgcggcgctgctccagcacccgtcggaggccgacgtgtccacgctgcggatgtgtatctccggcggagcctcgctgccggtggagatcctgcacggcttcgagcgtcgcttcggctgcgtggtgctggagggcttcggcatgtccgagaccagtccggtggtcaccttcaaccaccccgaccggccgcgcaaggccgggtccatcggcaccccgatcaaggacgtacaggtacggctcctcgacgaaaagggccaggacgtgactcccggcgagatcggcgaactggccgtccgcgggccgaacgtgatgaaggggtactggaaccgcccggaggagacggcagccaccatcccggacggctggctgcgcagcggcgacctcgcacaccgggacgaggacggctacctgtacatcgtcgaccgcaagaaggacatgatcatccgcggcggctacaacgtctacccgcgcgagatcgaggaagtgctccacgaacacccggccgtcgcgctggccgcggtggtgggcctggccgacgcgcatcttggcgaggagatagcggccgcggtggtgctgcgcccgaaggcgcaggccacgcccgacgagctccggcagttcgtcaaggagcgggtggcggcgtacaaatacccgcgcgaggtgtggctcgtggacacgctgccgaccggccccagtggcaagattctcaaaagggagatcagcgcgccgacggggtgaggtcaatgtggttgagtcagccgggtgacgagtagcaacgccgacgcgttcccgggttctcgagggcgccccggccgacggcggcactaggcagggcagatcggttacgcctgttccggtaccaacgccctcccctgacccgtgtccggcacttctccgaacgcaagcgggccgagaagaaacagcacaagcaggccgtgctcgccctggctcgacgacgggcccgccgccgtcatggcgacgctggccgcgagcggagcggcgctggtgggcctgccgcctctggtgtgagggagaaccggtctcttcccagaggaaccggcctctctgccgcgtcatccgatcgctcgtaccgccgactcggtcagagcggtctcggtggccgttgcgccacgtcgtgcgtttcccggagtgctcgcccgggacggctccgatgacctcggtcgcctcggcctcgatgagctcctgcaggatgcgctcgcacagcagcctgatcgtctcaactccaccggtgcgtagtgactgcagcagccgcatcaggtcagactgggacaaggccattgcgtgctcctccggtcgaacttcccgttcaccacggagacttgcgcgatggccggcccttgttcagggagcagacagcgacagcgggtgcacgccccgggcagacacccgcgcgctcacgaccctcgaccggctgcaccactcggcgggacgccattcatgccgtgggttcggactcgcggccctcacgctcacggaccttcccgcgcagccggtcgtggaactctgcgatcagcccgtgctcgcgccagcggcggaaaaaggcgtaaacccggccgcagtcggggaagtccgcgggcatcgcccgccacgagatcccgcccgcgaccagatagcggatcgcgtccaacagctgccggtgacagtagccctcgggccggccgccccggccccgcagtcaggccggcaccggcagcaacggccggatggctgcccactccgcgtccgacatgtccgacggataccggcgcacccgatcgggatgatcggccgcgttgccgtacacgtgcgcgagacaatcgcacgacacagcgggcgagttgaagtcaacgggctcgggcgcgtacaacaacgacaacagggcctccgggaaccgctcggaatgggatcgcgcccccgagctaccagggagccctgccttcatgcgcgtaccgccagaagatcacccgaccaggaactccgttcgacccacacgttcctagatcggttgagatacggcttctgacacccaagagcttgaagcggccccggcttcccgtctcgcatcgctcccgccgatgatgatggggcggcgatctccttcactcctcgccacgagtcacaccacctcaggtcgttgactgaccgtgacagtgttcctctgacggcatcgagtcccattcggtatgggcgccgtcgcgcggcaccatgaacaacggacgagaccgcaggacctgcccgacgcgttgcccgcgcatgacgaccccgggatcgtccggtcctgcgtatccctctggcgtgtagcgaaagtgtccgtccaccgcctcggcatgggcgatttcctcgctttccagttcccgtagctcccttccgaccagcgagattccgtcgtgctcgacctggggaccgtggacggcgtcggcagcgatgcagaacaatcccgcagcctggctcacgtatgccgtaacggcgggtggaacaggggccgccccacgatggacctcgatcttccacgtcggcgagaagatcgcgtggtcccgtgggcaatcgcccacccttgtccggccgagaacctgagccgcctcgaccacttcatcgacagtcatgccgaaccggagcggtccgacgcccaccttgggtgcgtaggaccactcaaccctgtcggcgactccggaatcggcttcggccttgaacgtcatagtcgctccatggagacacctgtgatcttgccgcccccatcatgtcaatcgctgaccaacagcccagtgccgcgcggtaggggtgagtcgcaggcgagcaggagtccttcgaggaggggcagttcgatgcaaccgcagatcacgagctgctgcagcagtccgagcgtgatgccctcataccgcagggcccactcggccaagcccgcccagctgcagcccaggccgcttcagaaggcaggaggctcgacgacaggggcggccgacaccgtgcccgccggtagtttgccgtgggcctcccacagccgggccgtcgggatgtccaccggatagccctcgatgagcaccgccgacttgctggtcaccgacccggatgcctcggtgaagccgctcatccagttcaggtccgcgtcctcgagcatcaggtggtcccgcctcgacatggccttgacataccagtccgacagcatgtgcccggcctggacgatctgccggtcgggatcggagagcgcgtagcggccacgcatcggccggcccgagcgggcgatgaaggagcccttctgccactgcccgtccgcgtcgaggaggaagtcgagcagtgactcctttcccgaggcccgttgggccagcagtcgtctgcgcatggcctccatgaacgccgacttcgaggagtagtgcggcagcacgctggccttcagcgtcaccggaagggtttcctctgcggaggacactgcggacggcaggctctgctttcgcagggtgctccaggcgcccatctcctggcccacctcttcggcggtcatcggcgtcgggcactcgccccacatccgcaggaacgcgttggtctcccgctcgctgagccccagcgtccgggcctgcgcccggacggcgtccaggtcggcgatggcgcgcagataggagttcttcagggtcgcgaggtccttggccatctccggcgcggcgaaccgtgccgcgtcgaggcccagtgtgctcgccgtctgtcctggggccgagggttgttcggccgccgccgatgagggtgcgccgggttgtgctgtgggttcggccaccgtcgctgagggggcgccgggctgtgccttctgttcggccgacggccccgcgaagtccccggccagcacgacgtcggccccctgggtggtcggcacatcctgcaagctcgaccgtgcgcccggcacgcccagttcgacaaccggggcagtgcctcccgtccccgccatcctcagcgcccgtacctgcgacagtcccagggacaagcccagcgcgagaggccgcacacgcgccgctataccgcggccgatgttgcccgccctcgtccgcactccgtgaccgaactcgaaggcacgccgctccgcgccggctccgaggccggcgcgttcgtgcaagagggaaccgatcgccgcggatctcgccgccgtggtgaaggcgtgctccgcgtcgccggtgcgcaggtattcgacgccgccctccgcggccgcgggcagacccacgcccaccaggcgccgcatcgcgggggaactcagcccttggctgtaccccccggcgaaaccgcccagcgctcccagtcccaggttcggcagtacgccgcgcaaggcggcctccgcacgggtcatcccctcgggcggcgcattgagtgcggccccggtcaggccgccgacgacgttgccgccgccctgcgccacggcgctgcgcaccatcgtctgtgcccgcgacatccgcaccgcgtgaagcccgaggttgcgagcgaagcccgtggccgcgccggcaccggcgccggtctggaggccctcgatcccgacccgttggccttcttcaagtccggcccgcagcacctgtcgtgccgatccgccggagaccgcttccccgcccgcaccgcccacaaagccgagtccggcgccgcccgcgccgaccatgcccgccgtgcccgccgtggtgagcgcggtcgccgtcaggccggtcgcgcccatgcccgccaccgccgaggcggcgaggggtgccgcgatgatcgctccggccgccagggcgacggtgtaggaaagattgcgtacggtcgtcagcgcgtcggcgatgtcaccggccgccgcctcggccttgcccacaccggcgttgacaacggctcgcgcctgttccgcctgcgccgtcgcggcgagcactgcctcgcccatcgccaccagggctccctgccgacgggccttgtcgaagtcgcgcagggccgccacggcctccagccacgggtcccgcacccggtcctggacctcgtagggctcctcgccgcctaccacgctgccggcgaagccgacgtacggctgctcctcgtagttcaggtgcaggtggtgccgcatgcgctcgtcggtggccgcgttcatggtgcggatcccccgggcggcgtcggcgagcgcggctaccgtctgctcgcgcacctggtcggccaactcctgcgggaacaggagcatttcgtcacggtggatgacgtacgccatgccgggctgctcgacggagggacggataccctcgatggtcctgaggttgtcgacgagacccgagctctgctcggccaccggtgtgaaggcctccgtcaggcgggcctggcggcgctcgccgctcgccctggccaggtcggcggcgaggtgcggcgcgagttccttgagttcctgccgcagcagggcccggtcctgccgggagaggtcggggcgctgcagccaggcggtgatgcggtcgacctcggtacgggcctccacggcgtcggccggcactgtgctggtgcgttcggcgaggacgcggggcatggggacctgttgcgggagctcctccgccgcgggggcggctccccgtgggcgccggccgcggcgcgtgcggtcgggagctgccatcgcgcggttcttgcgggcgagttcggcctcgatcgcagccttcgccgcgagcatggtgtcgtcttccggggtactggtggtctgccggtcgagccactcgttcaccgcgttcagctcgtccaggagctgggtcatgccgtaattgcgcacgtccgcagtggagttgagccagccctcggcagccgccgccacatgcgggccgaccgccaccggcggctcggcccgctcggggcgctccgcggcgcgcgcggcctgctcctccgcggcggctcgcagctctgtcggggccgttccggcagccccgccacgccttgtcatggtctgctgggccgcgtgcatgagctcgtgccgcagaagccggtcgggggcgccctctcccgggccggtggccaccgcgatgtcagggccgagggtgaacccggccacacctgcggcacgtgcggccgtacgcaccgccgggccggtgtgcagccggacgtggcccagggacagatcggtggcgcgttcgatcaacgtacgcgcggcagttggaacctcctggccgcggcccgacagggcccgttgagcaacaggttcggtcaatgcccggtggcccgccgccgagaacgtctgtgcgcccacccgccctccccacagcccgtcctgcgctggtcggcgaagtggttccgccgggctcagcatcggggcttcgtgtcatacggccgtcacccgggcgtcaacgcccgggctgggaccgcgacttgaaacgctctcgtatgcacccccacggctctggctgacctgtgcgcgccgacggcctcttcaccggttccgcatctacgccgacgcacccagcaccgacaaggccgcacccggcgcggtgcggcagttcggcgttgacaccgcggtgacgggccagtgactggcgcccaccacgatgcgagccaccgcacggcggtcccatgccgtcgggttgaggaggccgagggcgccatgacgacgcaattctcctatcccggtgtgtacatcgaggagatcgagagcccggtgcggcccatcgccggtgcggagacctcagtgacggcgttcgtgggcccagcgttgttcgggcccacgtcgccgacgaccgtggagagctgggccgacttcgagaaggagttcggggggctgtggcagggcagcgaactgagctacgcggtctaccagttcttcctcaacggcggcagcaaggcgatcgtggtccgcgtcggcgagggggtcgaatacgcgggggtcgacctcaagaacggtgtcaagctcaaggcgaaggcgccgggcgccgcaggcaagaagctcaaggcgaccgtgacgctcgacgccaacgacaacaagcgctacacgctcctcatctccgacgggaccacctcggagtcgtacgacgtgacgatcgacccggccctgcgcaaccgctggctggaccggcagctcgccacctcgcagctcgtggaacgcgacaccgagaccttcgacaagcggcccgacgccgtcacggacgagtcgttcaccggcggcaaggacgccaccttcacgcccgcacatgtgctgggtgacgccaccaagctgccgcacaccggcctcgcggcactggccgacgtcgagatcttcaacctcctggtgatcccggcccagttggccaaaccgtcaggcacggacgaccgcgacaccaagtgggcgcccgtcgtcgacgccgccgttcggctgtgcgaggagcagcgggcgatgctgctgctggatccaccgttcggctgggactcaccggaaaccgcggtgaccggagcccgggccgggatgccggtcggcgggctcgccgggcgcaacgcggccgtgttcttcccgaaagtagtgatctcggacccgctcagcggtggaaacctcgaggtcggcccggccggcacggtcgccggggtgatcgcccgcaccgacacccggcgcggagtgtggaaggcaccggccgggaccgacgacggcggcctgctgggtgtgcgctcgctggccttccggctgtccgaccagcagaacggcaccctcaacaagctgggcgtgaactgcctgcgcaccgtcccggtctacgggaacgtgctgtggggctcgcgcacctgccgcggcggcgacgccgtgagcgacccctggaagtacatcccggtcaggcgggtcgccctgcacatcgaggagtcgctgttcatcggcaccaagtgggtggtgttcgagcccaacgacgaacccctgtggtcctcgatccggctcaacatcggcgcgttcatgaaccggctcttccggcagggcgccttccaggggccgaccgcgaagggcgcgtacttcgtgcgctgcgacgcctccaacaacccgcaggacgacatcaacgacggcatcgtcaccatcgacgtgggcttccagccgctatcgcccgccgagttcgtccacatccgtatccagcagaagcgcgacgacgcgacggcccaggggagctgagatggcccagttcacggtcaatgccgcccgcctggacccgtacaagaacttcaagttccgggtgaagtgggacaaccgctatgtcgccgggatcagcaaggtcagcgcgctcaagcgcaccaccgaggtggtcgagcaccgcgacggcggcgaccactccagtgcccgcaagtcaccgggccggaccaagtacgagccgatcaccctggagcgcggggtcacccacgacccggagttcgaggcgtgggcgaacaaggtgtggaactacgccaacgcccaggcggcgccggaccagcgggaccgcgaggtctccctggccgggttccgcaaggacctggtgatcgaggtctacaacgaggcgggccagaaggtgctggcctaccaggtgttccgttgctgggtgtcggagtaccaggcgctgccagacctcgacgccaacgccaacgcggtcgccatccagcagctgaagctggagaacgagggctggctgcgcgaagcgagcgtcaccgagcccggtgagcccagcttctgacggttcgtcaaagactttacggggagggtcgggtgccggggatgagcacggtgagcgccgccgagttgctggacgcctgggaggcgggctggggccgcgatccgctgcggcgcggcctggctctgctcggtgtcgcccggggcaccacaccggccgccgccgcggacgtgcccgtgggccggcgggaccggggcctgttcgccttgcgcgcggcgctgttcggcaccgcggtggacgcggtgtcccgctgtcccgaatgcgagacggaggtcgaagtcgccttcgaccaggaagagttgctgggccggctggggcaggcggacccggaggcctgcgacgcggtgaccgtgcgggagggcgaccgtgagatccgggtgcgtatgcccacgagcacggatctggccgccgtcctcgacaccggcgacccggctcccgaggaggcgctcgtacgccgctgcgctcccgtcggggaaccggctccggccgccgacgtggtcgccgaggcctgggtggcggccgacccgctggtcgacgtgcggctcggggtcggctgccctggctgcggcctggcctgggaggagcccttcgacatcgtcggatacctgtgggcggagctggacgcctggggccggcggaccctgctggaggtgcacgagctggcgcgtgcgtacgggtggacgcaggcgcagaccctggcgttgagcccgtggcgccgccagtgctatctggggctggtgggcacatgaccggcccgctggcacgcctcgtcgaccgcagccgctcccccgtggccggtctgcgtccgcgccccgcctcccgctacgagcagcgctccccggcggccggcccaccggtcctcgaaggtggcctcgaggacgtggggccccgtccggtcaccggaccgcccacggccgcggaacccgccgcgcaccgggacgcctccgcggtacgggtaccgggccccaccgagtccgcggcacaccggcacgaccccgcggtgcccgccacccgcgtcatcgagcccgccgaccacggaccctccgtcaccgggctctccgtcaccgagaccgtcgcgaccaagccctcctcgaccgatgccgacctcctgggccccgacctgaccacccgcgccctgtccgccgtaccggccctgcccgtcgtacgagaggacgcacccgcgcgcggggacgggacaccgcagcccctgcccctgctcctcccggtccgcgtcgaggcccccgtgcctcccgcggactccttgcggaccacacccgagctgggccgtcctgctgcggatccgcggacaaacctcgtgcggaaccctgcggacgagggaccgccacccgtcccaccaccccctcgcgacaacgtccggaacacgcccgtcgtcctggagcgcccgctcctgtacccgcacgcccggccgcccgctctcgcgaccgacgctccgccgtccaccgccccggaggcggaaccggcggtcgtggtcgaggtgtccatcgggcggttggacgtacgtacgcccccctcccccgcgccccctcagacgccggcccggccgcccgcggcgctgcgggccgaccacgccagggcgctggagaactatctgcgccgccgcgccgagggggaactgggatgagcaactcccttgccctcgcggccgtgaccgccaccctgcgcgctcggctcttctcccggctcggcggcccccaggtcaccgtcgccccgcccaacaaggcgcccgacgcggcgagcggcgaccatgtgaacctcttcctgtaccgggccgatctcaacccggccttccgcaacgccgatccgcccggctggcagcccggcgagtcaccgaaacccgtgctgccgctggtgctgcactatctgctcgccgcatacagcaacgacgagggcaaagcgcacgaactgcttggcgccgcgatgctggcgctgcacgacgccccggtcctgtcgggggacgagatccgggcggcgacggcgacggccctgcccggcagcgatctgcatctacagcccgagcgcgtgaagatcactcaggagacgctgagccaggacgacatcgccaagatgtggacggcgttcgggacaccgttccggatgtcgtccgcgtaccaggtgaccgccgtcctcatcgacagcgcattgcccggtgccgcgccgatgcccgtgctgcgccgaggggccgacggccgcggaccgctcgcccggcccggtaccggctcgcccgcgctgctggggatccggtacgccgccgccgggcaggtcggcgccctgccgggcgagcaggtcgcgctactggtggagaacctgccggccgtcgccctgaccgcgcggctgcggcatctgcgcgtgacacagagcgtgaacgtgcccctggcgacccccgccaccggggcctccgaggtggcgctcacgctgcccgccacggggctccccgccgggctctgggcggtggacctcggacccgcggcgggcggttccgtgcggaccaacgaactcgctctgggcgtcacaccggcggtcaccgcgctcgcggccgcggcggcgggcggtacaccggtgcggacgaaggtgaccgtgacggccgcgcagccggtgctccccgggcagcaggccgcggtcctggtcggcgcccggcaactggccgtgggactgctcaccgcggccgccaaaccggtctcggtcaccgccgtcctgccgtccggaaagacccgggtgcggctgcgggtggacggcgtcgacagcgagatcgtcgaccgggcacacggcacgttccggaccgggccgacagtggaggtgacgatcccgtgagcctcggcgtcccggccgacctccgctgggaggaggccaacaaccgttatctgaaggcctcgttgacctggctgcgggctcggctggaggcggtggcccacagcgaccgggcctccgacgccccggacacgaaggacgcccctccccagaccggcagcgcgcgccggaggcggcgggggcgaacgcccgaactaccacccgcggccgtggacctaccggacggcggcccaggcgggtcacggcgaggacgagccccggagccgctgaccgccgtacccgacgcgggcgacctcgacgcactcgccaccacacggcaggacgccgccgccccctcggacctcgcgccgcccgcgctggtgcggctcgcggagcggttcgggctgaccgacttcgagcgcgacgtgctcctgctggtcgtggcgcccgcggtcgaccccggtgtcggcgccgcgatcgccgccgcacacggcgacccgcaggccaccgctccgacgttcgcactggccctacggctcttcgacgacgcccgctgggacgtgctgtcgccgctacggccgctgcgccgctggcggctcgccgaggtcgtgcccgcacccgcgggaccgctgctcacggcgccgctgcgccctgacgaccggatcgccaacctggtgcgcggcctcaaccacctcgacgaacggctcacctcggtactcgaaccggtcgccgacccggccgccggcgtcgcctcgcccgcctcggtccgacgcgccgaggacgcggtggtggcggccgtgctcgccgacacgcccgacggccggttccccgtcgtccacctcgtcggctccgacgccgacagtgccgtactcgtggcggtacgggcgttcgcacggctcgaacgcgagctgtaccggctgcggacggggctgctggtgcggggcgggcaaggccaacaagaccctgacacggtggccctgctgtggcaccgggagagtctgctgatgccggtcgcgctgctcctggacggcaccgacgccgacccggacgacccggccctggtcgcggccgtacggcgcctgctgtcccgcagcggcgggcccgtcgtgctggccgcgcgtcaggtgtcgccagtggacgggcggtccacggcggtcgtcgacgtcgatgtgccgccgcccgacgagcagcgcgcgctgtgggcggccgccaccggcctggagcccgccggggcgccggccgagctggcggggcagttccgcctgggcctgcccgcactgcaccgggtggccaccgcccaccggcccgagggcctctccgccgaagacggcggggaccggttgtggggcggcctgccgggacgccgcccggcctcgcctggagtcgctggcgcagcgcatcgtgccccgcgctcactgggcggacctggtgctgccggagcagcagacggaggtgctgcggcggatggccggtcatgtgcggcacggcgccaccgtgtttggggactggggcttcggtgagcggacgaaccggggacagggcgtgaccgcgctgttctccggtccgagcggcaccggcaagacgttcgcctccgaggtgctcgcccatgaactcgggctggatctctaccgcgtcgacctgtccgccgtggtgaacaagtacgtcggggagaccgagaagaatctgcgccaggtgttcgacgcggccgagtccggcggctcgctgctgctgttcgacgaggccgacgcactgttcgggcggcgcagtgatgtgcaggacagtcacgaccggtacgcgaacatcgaggtcagctatctcctgcagcgcatggaggcctaccgcggagtcgccgtgctggccaccaatctgcgggcggcgttggatcccgcgttcctgcgaaggctgcggttcgtcgtggagttcccggtgcccggcgcggaggaacggcggctgctgtgggcggcggccttcccggactcggtgccgctcgccgacgacctcgacctcggccggctggccgacctgccgacgaccggcgcggccatccaggcgatcgcgctcggcgccgccttcctcgccgcggcctgcggacggcccgtcgacaccgcgatgctcctgacggcggctcacgcggagttccggaaactggacctgcccctgccggtgctcgccggggaggcgccatgacggtacggcggatcgcggtgcgcatcgaccgggtggtactcgacgcgggcgtggccgagggccgttcggcggccgagatcgccgaggtgctgggcgcggcgctgcggcaggggctcgtggtacggcagggtggcgtggcacccaacagcgcccgcacctccctcgaacgactgcgggtgacgaccgagcacggcgggctcgatgccgtcgcccgggcggcgtcggaggcggtcgggcgagcggtggcggacgcggcgggctcctggcccgcggttacaggcgcttccgcccacggcaccgcgcggggcggtgacccgcgatgacctcgtccttcctccccggcaccccggtcgtcccccgtggcgcgatcgtgctgctggaccccgccaccggagccgtcctgcgggtgatcgccctgcagtacaaccccgacacgctcacccgcaccctgcagccgcagggcgtcggcgcggaggccggggagcgcagtgaagccctgcggctcaaggggcccgcgctcgagacggtgaaggtggatgtcgagctgaacgccaccgaccaactggaggacccctccggtgcggacgcggactccgtggcgcggcacggtctgctgccggtgctggccgcgctggacctgctggtcaatccgacggcgcgggcgctgctggaccaggacgccgcggcccgctcgggggcgttcgagatcgcgcccgtggaggcgccgctgacggtcttcgtgtggagccgggaccgggtggtgccggtgcggatcacggagttcacggtcacggaggaggcgttcgactcccagctgcacccgatccgggcgaaggtctccctcggcctgcgcatcctcaccgtcgacgacctgggcttcggccaccgcggcggcgccctgttcctcgcccatcagcggcgccgcgagcagctcgcggccctgcaccgctcggcccgcccggccacggcggtcctcggcacgccaccgggaggcggctgatgttcacccccgcgagccgctaccacggcgtcgaggtcgcccggtacgagccgccggacggcggcgacccgattccgtacgtccgccgcaggctgctgcccgaccccgccggcctcacaccggccgggttccacaccgtgtccgagggcgaccggctggaccggatcgccgcggccgcgttcggggacccggagctgttctggcggatcgcggacgccaaccccgtactggatccgcccgagttgaccgaccgccccggccgccggctcctgatcgccctgtccgccgcggccgccgggagcacccatggcttctgagatgctgctggccctgcggctcggcccggtgctcgccgagcccgtgccgcgcgaggtcgccgacgccctgctgtcggtccaggtcaccgagggagtcggccgctccggcggcttccagctggagttcgcgaccgccaaacggtccctgctgttcgccgagttgctgccgcagggcgccctggacccgcccgcgcgggcgcagatcgtcctgaccgtgctcgggaggtcgaccgtgctgatggacggtgtcgtcacccgccacgaggtcgccccgtccgccgaaccgggccaggcgaagctgaccctcaccggcgaggacgtctcccggatgatggacgtggtcgacttcagcggcgtcaagtaccccggcctgcccccggaggaacgggtcgcggtgatcgtcgccaagtacacggcgtacgggctggtcccggcgatcgtgccgagtgtgttcatggtggcgcccaatccgctccaggcggtgcccagtcaccagggcaccgacctcgcctacgtcagacagctggccgcgcaggccggttaccagttcttcgtggcgcccgggcccctgccgggcgtgaacatcgcccactgggaaccgcccaacaagctgggcctgccgcaggagccgctgctggtgaactgcgacgcggcgagcaacgtcgagagcctctcgttctccttcgacggcttctccgccacccagtacgtcgtgctgatccagaacccggagaccaagttccccgtcccggtgcccgtccccgacgtcagtccgctctccccgcccatgggccgtcgccgtccgctgccgctgaaggtgcaaccgatccacggccttgccaaactgaccccgccgcaggccgcgggagtggccctcgcccgggccgcggacagcttcgaggtcatctccgggcagggcagcctcgacgtgctgcgctacgggcagccgttgcgcgcccggcgtccggtaccggtacacggcgcgggcgcggcgtacgacgggacgtactacgtcagaagcgtcacgcactccatcaaacgcggcgcctacacccagcagttcaccctgacccgcaacgccttcgggccgctgtgagccggacgaccgaggacaccgcgcgaggagaccagacgtcatgacgaacatggacgacatcggctacgtggagtcgccgggcttcttcagccccgcgcagcgcgaggacgccgagccgccgggcgcgcggcgcttctacggcaagtaccggggctcggtggtcaacaacgtcgatccgctgggcacgggccgactgctggtgagcgtgccggacgtgttcgggctgttcccgaccagctgggcgatgccgtgcgtgccactcggcgggctgcagtccgggatgttcgtgaggccgccccaacaggccggggtgtgggtggagttcgagggcggtaaccccgaccacccgatctggacgggcttcttctggggcggccgcgccgagaccccggccacggccggcacgctcgtccccggctccccggtcttcctcgtggagacctcgggcaagagcaagatcgccgtcagcgactcgcccgtcacgccgatgaagggcggcggggtactgctgcagtcgccgtccgcgtcgatcaccgtggacagcgcgggcgtgaccatcacggcggccaacatcagcctgaacggcctggtcgacatcaacaacggcgcgctcgtcgtgaagacggcgtgaggagtccgccatgccgggattcgccctcaccaccgccgccgcgctgacctgcgcccaccagggccaactcaccctgacacccggtcagcagcaggtgctggccgggggcgcgccggtggtgacgacggccgacgtgaacgtggtcgctccttcctgtgtcctgtcctcgtcgacgccgccgacgccctgtgtgaaggtcgacttctccctggccgcctcgacccgcgtcttcgtgcagggccgccccctcgtggtacagcccgccggaccgggcacggggctggggctgtccgccgcccaggtgtcgcaggggccacccgtggtgtcgaccgtccagcagcgggtggtggccgcgtgagcgcgcacccggactacgcgaggacgcatctggacttccccttccacgtcgacgcgcgtggccggtcggccggcacgagcgacgagggccatgtccgtgacctgatcgagcagttgctattcaccgtgccgggcgagcgcgtgaaccggccggacttcggttccggggtgctgcagttggtgttcgcgccgggcggccaggagctggccggtgcggtggagtactccctccaggcctcgctgcagcgctggttgaccgatgtgatccaggtcgagcgggtcgaggtggaggccgaggaggcggagctgcggatcaccgtcggctatgtgctgctcgcgacgggcgagccgggcacggccgtggtggaacgggggacgggaccatgaccggcgtacccgatacgcgcccttgtctgccgggtgagcgggcggaccggacccgggagagcgggctcggcgcggtcgtcgccgtggatgtcgacgcgcccggccgcaccctgcgtgtgctgctcctcggcgcggcgcccgatccagtgcccggtgccgagtgcgtccggatcgaggggccgggacgcgcggtgcgcgccgtgtccgtacgggtggagggctcgccgccgccgacccggcgggccacgctgctcgtcaccgtggaccgtctcggcgaccgctccccgtacacgctccgcctggtcgatccagaccggcccggcgccccgttccccggcttcgatccgcggcacagcggcgcggagttcaccttcaccgccgactgcgccgaggaggccgactgtgctgctgtggccgactccccggtaccggccacgcccgtgcccgccctggactacctggtcaaggactacgcgagcttccgccgcctgatcctcgaccggctctccctcgtctcgcccgcctgggccgaccgggaggtcccggacctcggcatcaccctcgtcgagctcctcgcctacgtcggcgaccagctctcctaccggcaggacgcggtcgcgaccgaggcgtacctgcacaccgcgcgcctgcgcacctcggtccgacgccatctgcggctggtcgaccaccgtctgcacgagggctgcaacgcccgtacctgggtgcatctggcggccgaggagcccgcggtgctgcgcgccgggacgtactggttcgccaccgcgctgcccggcgtccgcccgctcgtctccgaggcccaactgcgcggcgccaccacatacttcgagcggtatgagcccgtggtcgccgccgatctggtgctgcgcccggcgcacaacgagatccggctgtggacgtgggacggcgaggagtgccgcctgcccgccgggacgacgtccgcgaccctggtcgacccgggcaccggcaaggagcgcgagctggagctggcgcccggcgacgtcctggtcctggaggaggtacgcggcccggtcaccggcgttcccggcgacgccgacccgcgccaccggcaggcggtgcggctgacggacgtggaggagatcacggacccggtgcgcgggcagcggctgctgcgcgtggtctgggccgaggaggacgcgttggccttcccgctgtgcctggccaccgtgggcggcgagcggtgctgtctgttcgaggacgtcagtgtggcccgcggcaacatcgtgctggtcgaccagggcagcagcggcacgcctcccctccgtctcaccgcgcccaccacggccacgggcccggcgtcctgcgatgacctgggccgacctcggccgcggaccgaggcgcccctgcgatggctgccccgcctggacaccggtccgctcacccggcgctcgccccaccccgacccggcgcgcacggcggccgcgcaggtgcgggcgctggaggggatccccgcgcgggcggcggaggccgtcgcggacatgtaccggcgggcgagcgctccgccaacggatgccgacctcgccctggcccgcaccctgtggggtgcgcgggcggtggccgacgccgggctggagacggcgcgcgacgccgcgcagcggagggcggcgctcaccctgctgcgcgcccgatcggccgccctgctggcccgacgcaccgcacgcctgacccggctcgccgcacgcgcccgcgccggcgtccccctcgacaccgacaccgccgccgaagtggccgcgggctggggccccgtcctggccgccgggctcgacccgggcgacccacgcgtcgcggggccggcatcggccgcgctcgtccaggatccgcgggccgcgctcccccagttgacgttgacgtcggcgggcgagcactgggaggtgcgggccgacctgctcgacagcgacagcgacgacccgcacgtcgtggtcgaggccgaggacgacggcacggcccgactgcggttcggcgacgggcagttggggcgggcggtgaccggcgggcaggagttcctggccgccgtgcgcgtcggcaacgggcctgcgggcatcgccggttcgggcacggtggtgcatgtggtggtgagcgcgccgaccgacgcacgcgtcaccgccgtacgcaatccgctgcccgccacgggtggtacggcgcccgaacctgtcgccgacgcacggctgttcggccctacgcagtaccggcaccggctggagcgggcggtcaccgccgacgactacagcgcgctggcgggcgagccggccggggtgcagcgggcggccaccgaccttgcgtggaacgggagttggtacgaggcggacgtggcggtcgacgcgctgggccgtgtcgatcccccggcggcgctgctggacgccgtgcgcgaccgtctcgaacgtggtcggcggatcgggcacgacctgcgggtggacgcgccgcgcacggtcgccgtggaggtacggctgcagctgtgcctcgcgccggacgcgcgccgggccgccgtggagcgggcggtacgcgcccggctcggcaacggagtcgggggcctgttccaccccgaccggctgaccttcgacagcgacctgtacccgggccggctggtcgccgaggcgatggcggtgccgggcgtggtggcggccgcggtggagcggctgggccgcgccgaggcgcctctgccgctcgtgccggacgacggggtgctggccttcgggccgctggagatcccggcgggcggcgcggatccctcgggccccggcgccggggtgttgtggatcgatctggcgggaggacggtgaacgcccatgtgcgccacgggtgagggcagttgctgctgcacgaccggggccgggaccccgctgccgacggacaacccgcccggcgccgcgcggttgcgcgcccgggccggcacccacgccacgttcctcgcgtcgatgaccagggccctgtccggctccgcgcaccccgaactggccgagctcagcacccgggaccccgccgaccccgcgctggccctgctggacgcgtgggcctgcgtcggtgacgtcctgaccttctatcaggagcgcatcgccgacgagggctacctcgggaccgccaccgaacgccggtcgctggtggagctgggccgcctggtcgggtaccggccgcggccgggcctggcggcggacgggtggctcgcctacaccctggatccggacccggccgacgtggaggtcacggtccccgccgggtcgcaggtgcagagcgtgccggatccgggggcacagcccgtggtgttcgagacggcggaggatctggtggcgcggccttcgtggggcgcgcttcgggtgcggactcggcggccgatgccgatgacacgcgagtgcgcgctgggactgcgggtcgtgtacgtggacggggtgagcgcgggggtcgccccgaacgaccggctgctgttccacttcgacgacggcaagctgcccacgttgcggatcgtggagtccgttcacgccgacgccctggcgggcacgacagccgtcgctctggtgcggatctccgacaagttcgagaaggcgtgccgggagaccgtcgggaggacggggagggccgcgttcgtacggctcgacgtgctgcgggtcagggcggcgccgttcggtaccgccgcgccgcagaaactgaagtccaccggcgaggtgggagccaccgccgcggcggtcccggagttcgaggaatggccgttggaccccgccctctacacagtggggacgaaacccgaggaggaaaggcgccggctctggctggacggggaccatccgcggatcctgcggggcagctggatcgtcatcgagtcggctgacggctgggggacgccgttccaggccaccgacgtccgcagccgcggcctcgcgcactacggcatcacgggcaaggtcaccgtcctcgacctgccgacgacgtggtacgacaacccggctgacggcaccccgttgctgagcctgcacaggggcctcaccgtccacgcccaggccgagcccctcaccctcgccgacggccccttcaccgacgggctcacgggatccgccgtcgacctggaccgggtgatcaccgccccgcccccgtcccgcaccgtcctcatcagcggcgcccccgtcgacggcggcgcgcccgccggcgaggtcgcccacgtcctggccacccacacggtcaccgaccccaaccggccgggggcgaccccgtacaccgtcctcgaactggccgccgggctgcgccacacctaccgccgcgacacggtcaccgtgtggggcaacgccgtacgcgccacccacggcgagaccagggaggagccggcgctcggcagcggcgacgcgtcccggccgggccagacctttaccctggccgcgcatccgctcacccacgtggcggcccccgctgccgacggaggacaggccgaactcaccgtcagggtcggcgagtcggcgtggtccgagacggacgagatcgcccacgccgcccccgccgagcacgcctacgaactccgtgcggacgacaccggcaccgccaccgtcaccttcggggacggccgtcgcgggtcccggctgcccaccggcacggccaacatcgccgcccgctaccgggtcggcctcgggcgcgcgggcaacctgcgggccgggcagttgagccagttgcgcgccaagcccctcgggatcgacgccgtcgtcaatccgctgtccaccggcggcggcaccgacgccgacaccgacgccgcgctgcgcggccgggcgccgctgccgacgctggccatggaccgcctcgtcggcctgcgtgactacgccgacttcacgctggcccgggccggtatcggccgggcggccgccgcccggctgaccgtcggcggccgcgaactcgtgcacgtcaccgtggccggtgtcgacgacgccgaactcgacccggacacggccgtcgtcacctccctgctggccgcgttccgccgctacggcgacccgggcgtgccggccgccgtcgcgccccgcacccgttggaacctcgtcctccaggcccggatcggcatcgcccccgaccgttccgccgtcctgctggagccgcgcgtccgggcggagttcgagcgtgtcttcgccttcggcgcacgggagttgggccggagcgcgtacgtggcggaggccgtggccgcgcttcagggggtgccgggggtggtcttcgtggacgtacggcgtttcggtgcgactctcgggacgacacccgccgacgcggccgaggtcacgggggtcgcgcagcgtgtcctggcgcggccggcccgcgtcgagttcggagcagcgccgccgacggaggtcgtccgtcccgcggatctcgtcgtcgccgcaccgggcctccctggcttcgtcgtactgaacctggaggtggcccgatgagcagcccgccccccgaccgcctctacgacctgctgcccgcggtccaccgcggccgcgacgaggaacagggcttcccgctgcgggcgttgctgcggatcgtcgaggagcaggtccgggtgatcgaggaggacctggacacctggtacgccaactggttcgtggagacgtgcgaggactgggtggtgccgtacatcggcgccctggtcggcacccgccccccgccgccgggcagttcacccggagcggtccgcgcgctgtcgccgcgccaggacgtggcggacgcggtggcgaaccggcgtcgcaagggcggtgcggcggcgctggaggcggtcgccctggacagttccggctggcccgcccgggccgtcgagctgtaccggcacctggtgcgcgcccagcacgcacggcatgtgcggctcgaccgccccgccaccttcgccgtgcgcgacccgctggcctgcgcccggctcggcggccccttcgacgacgcgccgcacctggtcgacgtacggcggccgaacagcacgcagacccgtgggctgcacggcatcccgagtctggccctgttcgtctggcggctgcgggccttcccggtgacccgggcgccggcgttctgcatcgaccagcgctacagccgctatctcgtcaacgtcctcggtatcgacacccggttgttcgccccggcaccgcaaggcccggcgcccgcacgggtgtcgggccccggcgacgtaccgcatccgctggggcgggaggagttcgaggccgccgtcaccgagtactacggcccaggcagaagcctggagatctggcgggactcccccgacaacccggtaccggcggaacagatcatcgtcgccgacctcaccgactggcgctatcggccgcggccggggcaggtcgtggtcgacccggtgctcggccggatcgccttcccggcggacgaggcgccggaggacggggtgtgggtgagctggcactacggtttcgccgacgcgatgggcggtggcgcgtaccgacgcccgcagaccccggtcggcgaacgcaagctgtacgcggtgggcggcgaggacgacttgggctcgatcacggccgcgctgcggcagtggcgggcggacaaggcagcggatccgtcccttcatgacgcgctgatcgagatccgcgactcggccgactacacggaggccctgcggatcgacctggacgaggacgaccggctcgagatacgcgccgcacgtggtgaacgcccggtcgtccgcctgctcaaccagaaggccaaccgcttcgacgcgctcaccgtacgggccaccgcgaagaagccgccgcccggcacggtcgccgactgcccgccgccggccacccgccgcccgcaactggtcctggacggtctggtggtgagcggccgcagccttgacgtggtcggccagatcggcgaagtgctggtccgccactgcacgttggtccccggctgggagttggaccacgattgccgcccccgctggggcgaggaaccgtccgtcgaactgcgccgcaccacagcccgcctacgcgtggagcattcaatagtcggcacgatcgtggtggaccaggacgagacgaagggcaacccgctgaccgtcgagatcctggactcgatcgtcgacgccacgtcccacgacctgcccgccgtgacagcccccgaggaccgtttcgcccacgccgagttgaccctgcgccgctgcacggtcctgggcgacgtgcgcgtccacgccctccccctcggcgagaacagcatcgtcacgggctgcctgcacaccctccgccgcgacacgggctgtctgcgctactcgtacgccccggtctcgcaccctggcccgccccgctaccgctgcgccacggaccccgcccgtccgcacttcaccagcacccgctacggccaccccggctactgccaactccacaccgcctgcgacccgttgatctccacgggcgccgaggacggcgccgagctgggcgccttccacgacctgtaccagccccaaagcctgagcaacctcgtcggccatctcgccgagtacgtgccgctcggcgtcgaggcagccgtcatcaccgccacctagggggacgccgtgcacggtgacttctcgaacatcacgttctcgcccgaccgtagctattcgaccgtgttcgacctccagggacgggtggggctggacgccaaccggaacgaacagacagccatcctgctgcactacctacggacggcgatggccgacctggtcgggccctacgccggccccgccaccagcctgggcttcgagatctccgacatcggcaccggcggattctccatcggggcgggccgctactacgtggacggcatcctcgtcgagaaccccgccaaggtgacctacgccgagcagccgcacgcctacatcgacctcgacgacgccgaccgactgccgtcgggcagttacgtcgtctacctcaaggtctgggaacgccacgtcaccgaggtcgaggacccctcgctccacgaacccgcgctcggcctgcaccagcccgactcggcgagccgcgcccaggtggtgtggcaggtccgggcactgccgctcaagagccggcagaaccccgtgcaccggatcgccgccgagcacgcaccggaccggggcacgggcgtcctcgacgtccgcacctcccgcgacgacagctcggccgacgatccctgcacggcgtcgcctgacgcgtcgtacaccggcgagaaccagctctaccgggtggagatccggcgcggcggtacggcggccgacggcgcgacgttcgcgtggtcccgggacaacggctcggtgatccaccccgtccgccctctcggcggcaccaagatgcggctgacgtcaccggcccgggaccggcacaccgctctggagcccggccactgggtcgaggtggtcgacgacgcgatctcgctccgccgcgacctcggcctgcccgccggggcacccccgctccaccggatcgacgacatcgaccccgacaccctgacggtcatcctcgccaccacccccgacccacccgtctcccccgaccgccacccctacctccgccgctgggaccacacccccctcgacaccgactcgggcggcgcgatcccgatcacggaaggcccctggatccccctggaacacggcatcgaaatccacttccagccctccgcggcacgggagccggcccacgagtaccgctgcggcgaccactggaccttcgccgcccgccggactctcggcacggccatctggccgtatccgggtgggagtgggccgcatggggtgcggtatcacttggcgccgctggcggtggtggcggggagcaaggtgagtccgctgcggacgtcgttcgcggtgccgttgacgtcgggcgtgtaagtgcccctatgtcctctgaaggaaggcccttcgatgattcgcgcgctgatcgacagaggccggacgggccatgatgcggctgctgttctccacagccgaggccacccccttgatgccgggatcaggcagaccatggagatggccttcggtcatgacttcagccaggtgcgtgtgcactccgatccgcaggctcacgccctgacccggcggatgaacgccagggctctcaccctgggcgaccacatcgcgctgggccaggactggtacagccccgattcagcggacgagctccgggctctggcgcacgaactcgcgcacgtcgttcagcaacgatccggctgtgcggaaccgccagccccttctccccatacggaaaccgagcatgaggctgtcgcggccgccgacaccgtgatgggcggcggagccgcccgggtacgcgggcgcaccgggatcggtgtcgcccggcaggccgtcgagtccgacccttccgacctgtccgacacgcaactcgaacaggagtggctcctggccgcggcatggctggtcgaccactccatgctcgagagtgactacttcacggtggcgaagtatgtgaaatccctcgaggacgcgatgcggggacgcgcgggaggcgcacaccgggctcagtccgaggggacgctgccgttggagccgctgcggcccagcatccttcaggtccctctccggtcgcccgtcggtgcggcaggctccagcggagccgttcccgccgccccgcgaccggtagtcgccacgcccctcgacataccggctgagggggtcgacatgccctgggtcggccgcgggaaaggcatctcgtccagcgagctcggttacctgcgagactcgaagtacttctggccccggttccagcagagctacggttccgccatcagcctggccaacgcacagctcatcgcgtcgggccaggctccccgcgtcgatgccacctggatcgagcatttcccgggccatgccgcctatgtgaacgacactctggaacaccatcacgtcggccaggggtctcgtgccgttccgctgccgagccgtctgcacgacgcctacacggtgtttcacccgcagcgccgtgtggtgagcacaccgcagggaggcctgcgaccgatacccccaccacgctctcacgccgacgcccagaccaatctgaacagccatgtggaggccggtcgtatcagcggcccggggatcgacccgacgaagccgcccactgttccggccgtcccaccggcctcagaagtagccggacaacgagccacaccgccggcggccgtcccccggatgttcggagggggccggatacgggggctcgtcggcggaacgatactgggcggcctccagctgctcgccggatatctgtccgccaagctccaagaccacttcgaccagcagcgctgggaacgggaacgggagaccattcaggcacaggtcgaacgagagctcgacgggatgtccttggagatcaccgaccgctacctggacgctcctggcagggaggtattcgccgtcgtcgcgatcacctccacggcactccgcacggtgcaggtctacgctacgggcatacaaagtgaagtcgtggaccagaccgtgtacttgggcagcaagctcgcgtctgtggaactcggctccgcggcccggagtgagcggcatgaagaggtacggcagatagcggccccgctcaatctgggtttcccgaccacgacgtacaccaccacgaccttgtactcattcgcagtgccgagcccggacctcatcgccttgcgttggcgggccttggaacgacttcgcgacctcgatctgcaggcacccgcgtcacagactgctcaggccgctgccgcggtccaggaggaacgaacccgcctgtccgcctggctgcgcccctccgccgactagcgcccgggacggcggcagtgaacggccgacagcatcacgtcgcgcctgacggcggattcggacggtcgtgggcacaggcgtccaaccactcgtgtacgacccccaggaccgcgtcgcgcccgaccagcaccatggtttcacctggggtatgcacgtcgactgcctggatgacgcgggcgcgcagcgtgggcgaagcgggctcgaaccacacagtgatcagcagcacggcggtgggagtctccggtgtttcgctcatgccggtccgctcgtcggaggatgcgcatgggccgacactggcacggtcctgtcacacgcccgtcagtcacggatcaacgcgcaggccggaagcatcgaagtgaagcccagagaaggggcgataccgagttcgatgcggagaaggtccttgaacgcccggtaatgccgaatcgcctccagcacattgtgctcggccaggtgtaccgcgaccacagctcggtgggcgctctcccgcaagggttcgatcctgacgctctccaatgcggcctccagagcgagggcgtggtgcccctccgccaagagtcggtgggccagggagtccagcgcatgcaaacggagctgacgaagacgttcgcgttcgaagagcacccagtcctcgtcccagccggggaggaggtcgccagcgaagagcaggtcccggggcggtgcgggtgccgggggtgatgtgccgaccacgtgcagggccgagttcatcagggtccgggcgtccacggtgaccgactcggccagtgcgagggtgtcgccctcgctgcacaccagcggctccctcccccggtgcagccgccagagcgccgtacgcaagctcccgtgcgcccgttcctccggcacgtccggccacagtgtccccgcgaccaccgtgcgggtgccgtggtggcgcatgccgaggtaggcgaggaggcgttgggccgcggtgccgacgtcgagcgtggtggggccgtaggtcagggtgaagcggcccagtaggcacagtctgggcgcgaacgtgtcggcagtgctcatggcgcctcccccgacgcatcccacgagtccgatcgatgcaactgcacaagagggttccggcgcatcggggaactccctatgttcgtaaggtttttcacgaaacgccaaagccggacaaggatgcgcaatcgcccacgtcgatcaccccgacgggagcactctggtgacgcggcccacggccgcgggcgtacgggggcgtcatggacgagacgacggtcgtgaccggcggcgtaccgggggccgggacggggccggccggggacaccgagttcccgccggtcggacgagagtgtgaacgggccctgctcgacgggctgttggatgccctgacggagcggggtggcgccctgctgctcagcggtgacccggggaccgggaagagcatgctgctggggtacacggccggccgctgccgtacgaccgtgttgcgggcccgcggggtggagtcggaggcggtgctgccctataccgtcctcgccgacctgttgcttccgctccggccgtacttcaccgagctgcccccggggcagagacgggcgctggagggctgtctggcgctggcggacgtggcggggcccaatccctatgcggtgtgcgccggtgcgctcggtgtgctagcggcggccggtgaggtgcggccgctgctggtggtcgtggacgatctgcactgggtggatccctcgtcacggcaggtcctgcagttcgtggcacgcaggctgaccacggagcgggtggcgctggtgatggccgtgcagcccggggccgaagaggacggcccgtgggcgagcgtgccgcgggtggcgctggggccgctggccgaggacgactgctggacgctgctgcgacggcacggactggaccgaacggatccggcggcggatcggctggtccggctgtcgctgggcaatccgctggtgctcgtcgagtacgcgggcatgctcgcccggatgcgcgcgacgggagccacgcagtgggacgagatgtgggaggcgcccgggccgctggtggagcgggcctggcggggacagctgcgcgcgctgccgcatcgcacccgggaggcactggtgtacgtcgccgcctgccgcacacccgacctcgccctgctgaccaaggcgttggcggcggacggcacggacctggacgcgctggacgcggccgagcggaccggactggtgcggatccgggacggcgtgtgcgagctccggcatcccgtgctgcggccggtggtgctgggccagtgcaccacggcccgccggctccaggtgtatcggcggcttgcggcgctgtcatcggacgagctgcggacctggtatctggccgccgccgcgcccggcccggacgaggcggtcgccggccggctggccgccgacgccgaacaggctcgtaggcgcaatgcgttggcggccgcggcatgcgcctggcaccgtgccgccgagctgtccccggaccccgctgacgccgcgcgtcggctgctcgaagcggcccgtgacgccttctgtggcggcaccgcacgcgacgccgcccgctggtgcgaacaggccctcgtgcacagccgtgacccgcggctcaccgccgacatcgggctgctgcgcggacaggcctgcacctggctcggcgacccggcccgcgcccaccggctcctcgtcgacgccgcccgtgcggtggaacccgtggaccggccccgggcctgcctcctgtacggcgccgcggtggcgcccgcgatgatggacggtcggctgcggcacgcctccgacatcgcggcacgctgccaggaactcgccgacgacggacgggacacccagcgccggcacgccgccgtgatgcgggccaaggcccaggccctgggcggcgacgtgccgacaggacgcgcggccctgctcgcgctcctggacgagagccacagccctgtggccatggacatcgcccgcggccccgaggaacgccagatcgccatggacatcgcgcagggcctctcctggacggacgacggcgaggccgcccggccggtgctggacgcagtgatcgagtgcacacggcgcgacagttcaccgacgctcttgtcgtacgcgctgctgggccggtgcgaggtggagatgtggagccattggcagcaggcacgtgcggacgctgcggaagcactgcgctgggccgaggagttcgggcttctggcgatgtcgggctacgcactgatccagctggcccggctggatggcctgcggggcgacactgcggcctgcgaggagcggatcgcccggtacgagcactggtgcggcggccggctgcgcggtctggacatgttcgcgcggggcacgctgggggcggccgcgctgaccgccggggatccggacacctgccgtacgcacctggaggcggccttccggatggccgacgggatggggctggtcaaccccagcctcatgccgtgggtggcggatctggcggaggcgtctctgcgtaccggcgcacgggagcgagccgtcgcggtcgcggactggctcgccgagcgcgccgaggcgaccgcgctggcgtggcccgcggccgcgtacgcccgctgccgggtgatgctggcgcggacggcgcaggaggccgccgactggctcgccaccgccgaactcgcccacagcaaacgggagatgcctttcgaacgggcacgcacccggctcgtcgccggagaggtgctacgacggttccggcggccgtcggcggcgcaggaacccctgctcgccgcgcagcgcacgttcaccgcgttgggggcggcgccgtgggcggcccgagcccgggcggaggtcgcggcggccgggcaccgcaccgccgtccgccagaccgagccgtccttgacggagctgctcacgccccaggagttccaggtggcacgggccatcggcgagggtctgagcaacgtcgaggccgcggccgccctgttcctgtcccgcaagacgatcgaggcccatctcacccgcgtctaccgcaagctgggcatccgctcgcgctcggacctggcacgctgcatggcacacgccggcgccgttggataacgcctcatcaactgcatcccacacctcgcggtcgaaccggtcctcaagctcgaccgcggtgaactcccgcccggaacggctggtgttcttcaagccaccaaagcgccccgcaccgtgagggtccgacagcggcgtccggaaatctcagcccggctttgtcggggctgcttcccgccgtccccgacacctcccggttcaggctgcctagtactttcttcacgcctgggcgccgcgacgccgccgacggcctggcggtgcgcgccggacgggacgcggcagtcggcgccgcggtcttggcggggtgggactgggtgcctttttcagtcgtgaccgctgcctcggacgccggacctgtggacacagtccgcgcctccaccggggcggcgacgtcggtgaacgcctcgggcaccaccgtgtcctgaacggtagggcggcgaaagagccgcccacggggcctcggacggcctggtcgatgagttccttgacccagtcggcgggcgttggctcgcccgggatttcccggaaccagagccgtgcctcctccttggtgattctctgggagcgctctccgaggtagggccagacatagacgagtgtgcccggctcgcagtgccaggcgttggcgagtgcgccgatgtcgacggcgtcgtagcccaggacgtcgagaagccggacgacctcggccttggcggccgggtcatcaccggccacggggggcactgcggtccggtgcgccaacgcctcgatctgcgtcagcatccacgaccgcatgagcccgcttcagcgggcggagctgctgcgactgctggcggagcacagcagtgacggcacgacgctgttcaaccctgaagaagcgcggggtactggcgccggtgatcagcgcccgccgcgccccggcccggcgtgagggctcacttctagtcgaccaggtggccgacgcccgcccgaccatgcgcaaagtgtgggtggacgtcggctaccgcaagcatcgcgtcgggcacgccgccagcggaaaacgacctatcagtggctggccaccgtcgcctggcgtgcggccggggccgcgtcgtgtcggctgtcggtgctgagcgcgtgcaggatctcctccacgctctgtttggcgtcgccgaagagcatgctgctgttctcgcggaagaagagcgggttctgcacgcccgcatagccggaggccatggagcgtttgaagacgatgacctgctcggcttcccatacccgcagcaccggcatgccggcgatcgggctgcccgggtcctcggtcgcggcggggttgacggtgtcattcgcaccgatgaccagaacgaccgaggtgtcggcgaagtcgtcgttgatctcgtccatttccaggacgatgtcgtagggcaccttcgcctcggccagcagcacgttcatgtgcccgggcaggcgcccggcgacaggatgaacgccgaagcggacctcgataccccgctcgcacagttgccgcgtcagctccgcgaccggatgctgggcctgagcgacagccatgccgtatccgggcgtaatgatcactgagcgggcctgagccagcatctcggccgcctccgcggcccgcacctcgcggtgctcgccctgctcctcctcgccgccggacggcgccgcgatgccgaaaccacccgctatgacggagaggaacgaccggttcatcgccttgcacatgatgtacgacaggtaggcaccggaggagcccaccagcgcgccggtgacgatgagcaggttgttgtcgagcaggaagccggccgcggccgctgcccagcccgagtagctgttcagcatggagacgacgaccggcatgtcgccaccgccgatcgaggcaaccaggtgccagcccagggccagcgccagcgcggtcaccgcgatcatcaggggtaggttcgggctgatcgcgaaccagatggtcagcacgacgaacgccgcgagcgcgccgaggttcagcgcgttcttgcccggcagcatcaagggacgggacttgatgcgcgccgagagcttcaggaacgcgacgatcgagccggtgaatgtgaccgcgccgatgaagatcccgatgaacacctcggcgtggtggatgcccagcaggttggcgccgatccgggtctgcgccgagccgtgggaatccacctccaggtagctgttccagcccaccagcaccgcagcgaggccgacgaagctgtgcaggacagcgatcagttcgggcatctgcgtcatctcgacgcggcgggcccgccacaggcccatcgccgcgccgagcgccatcgccagcacgatcagcgcgaccgctccggcggtgatgctccgcgccgccacaaccacggtagcgaccagggcaagggccatgccagcaatgccgtagacgacgccggcgcgggaggtgcgatgctgggacaggccggccaggctgaggatgaacaacagggcggcgaccaggtcggcagcgtgtgaagccttcagggaggtcatctcggctcagcctttcgagaacatggacagcatgcggcgggtgacggcgaaacctccgaaaatgttgacgctcgtcagcaggatcgccacgaaggacagcgtggtgacgatccagctctcgtgcccgatctgcagcaaggccccgatcacgacgatcccggagatcgcgttggtcaccgacatcagcggggtgtgcagcgcatggtgcaccttgccgatgacgtaatagccgatcaccaccgccagcgcgaacacggtgaagttgcccgcgagttgcgtgggagcgaaggccaccagcaaaaacatcgcgagcatcccgagcccgatcaggccgaagcgccacgcaggcgtcaggttcgactgcttcggttcgggcgctacgggtgcggccgcaggctgcgcggcgggcgcggccgagaccgcgacgggcggcggcggccaggtgacgtcaccgtcgcgcaccacggtcaccgcccgctgcacaacgtcgtcgaagtcgaccgtcagctgcccgtccttgccgggagtgagcagtttcagcaggttcagcaggttggtgccgaacagctgcgaggcctgggccgggagccgggaggccaagtcggtgtagccgatgatggtgacgccgttgtcggtcaccaccgtccgccccggcacggtgccctcgacgttgccgcccatcgcggcagccatgtcgacgatgacgctgcccgatttcatgacggccacgtcctcggccgtcagcaggcgcggcgccggccggcccgggatcagcgcggtggtgatcaccatgtccacgtcctcggcctgctcgtggtagagctgggcggcggcgcggtcgtagtcggcggacgtcgccttggcatagccgtcggtgctcgactcctgaacggcttccaccggcaggtactcgccgcccagcgacttcacctggtccgcgacctccggccgcgggtcggtggcgcgcacgatcgcgccgaggctggaagcggcaccgatcgccgcgagaccggccacacccgcgccagccaccagcaccttcgccggcggcaccttacccgccgcagtgacctggccggtgaaaaaccgtccgaaggcgtgcgcggcctcgatgaccgcgcggtaaccagcgatgttcgccatcgaggacagcacgtccatcgactgcgcccgcgaaatgcgcggcaccgcgtccagcgccagggcggtcaccccggcgtcggcgagcgcctgaagcagctcgggcttttgcgccggggtcagcagggcgaccacggtcgcgccctttcgcaaccggcagatttccgcgtcggagggggcgttcaccttcagcacgacatccgcgtcccaggcctcgccaatccccgcgccggcatcggcgtacgcctggtcaccgaagccggaggcctcaccggccccggactcgacgacgacctcgtagccgaggcccagcagcagtcgtaccgtcgccggggtcgccgcgacccgcgtctccccggagacagactcggccactacgccgatgcgccggggaggatggtgtgagggtttttgagcagacatatcctgtatctctcgtcagaggagggtgcgaaagggaaatctgcgctcggggaagttacgacgtcctccccacgtgatcgctggaacctaacccgtcagacgggtgcgggccaacgcgatcggacggtgatgtgcttcaccttgcagtaccggccgataatgatcggtccgcgcgggaccaaaaccagcgggcctcgagcagtcggggccactccgccccgccgcggcccccgatttgactgcgcgtccgtcggctcgggagtgtcaggaacgctcacagagcacgtgaggggcgggcggttcatcgggcgcggccatgcgctggacgcccgtgtggacggtccaggccggcctgacgggcgcagggttggcactcgatggcgacaccgacgtcaaccagtgcgattaccggcagccttgggagcgtcaggtcgcagggctccgccccgggcaaggacgtacgccgacagtacttcgccgtcaagtttgggacccaactctgcggtctgcggacacgacgagcacgtggagacgctgtgcagagtcgggcacgcacatcaccgcaacatcagcgactttggtgtgcccgccaggaggtcctcgttggtcagccttctttgtgtaggacaacgcatcgcctgtggtcatcgacacttccccatcatacctactggtcggtatgctgcggcgagccgtaacgacaggaggcgcgatgtccgtgaccaaccgccagatccgtctggccgctcgcccggtgggcgaagttcgacccgaggagtgggagcactttccgggcccgtcgaggagcccggctaaagaaagcattcgaggacgccgacagcacctacggctaccggagcgtgcatgcccagcggcaaggggctgttgatgcgcacggtgcgccgacggtggtctacggctgcgtatcggcgtggtggcgggtcagtgcctgccagcgccgctcgaaatcctcggactcttcagcgatgtaggcggggtgacgggcttgttgtactgggcggtgatgccccagtctgcggacgcatgcgcaatgtccgactgcgcagcaacttcggtgcgcactcgctgctcggcccagacgttgtacacgcgccggcgcacgaagagcaggcgcaagctgctcgggctgacgggcttgccgccgcgaccgagcagtcgcttctctgcgcggtaggccgacagctgctcgtcgctgggtcgctccccttctggtcccggtactccatccacgcacggtagtagcggtcggaagcagtgaggtcgcctccccgtcgccggctgtcgcgcctcgtctatggcaccatccacgcgggggccgcgcggctccttcaccgcctgcggtggagcaccgacaggcgccgactgcggctcttgcgcctccgggaacggctcgtcgggttgcccgtgaacgccgcctcagcacccactgccgcggccgagccgcgcgacgccgccggacggccgccggtccgcgcggcaacccccgctgacgccgaaggcatcacccggatgcgctccgcatacgtcctgtccgcaccgttcaccgaggactgggtccggcagtgcacggacgagctggcgccacggctcacgccggaaggagccgcccgggccttcgtcgtcgacgccccggacggcacgatggccgcctgcgccctcggcctgatccaccccgtgctcccggccccggcctacccccggggccgggccgcccgcgtacagatcgtcgccacccagcccgagttccgccgccgcggttacgcccgggcggtcctatccgcactcctcgaccacctcggcgacgtcgaggacgtcaccctgttcgaactgcacaccagcccggaggctgcgcccctgtaccgggagctcggcttcagcggcagcccggcactgatgtggatgacccgccaccgtgaacgtgccggtgctgtggccggtgcgcagccggactcgacgtggatgccaccgcagtagtacgccgacgcactgccccgggcggccgcgtacgtgtgcctctacgtcaccgacgaggacgaccggccgctgcagctgcactccgtctactcccccggccacccctggcacatgatcggcggcgcgatggatctgggcgagcggccctgggacgcggtggtgcgcgagggccgggaagagaccggcatgaccgccgtgggcccggcccggctgctggccaccgtgttcgggctgccccgggagggacgttcgtacagcactctgcagctgatcttcgacggcggtcgtctgaccgcggaacagatccggggcatcaccctcaattcgcgcgagcacgacgaggcccgcgtcctgcccttggccgagtgggaggccttgatgccggcccgcgatttcgtgcggctgcgcgccgtggaggaggcccgccgcaccggcgtggccgcatacgtcgacacctgggggcacgcatgagcgccagcagcatcgtcttgatgtccgaccggcgggtcgccgcgatccctgtccaggagcgcggcgaggtcctcctcgacgcccgcgtgcgcggcctggtggtcgacgaccgtaagcaggacgctgcgggcgcctgggccctcgtccgccggggcgtgctcacgcggctccagcaggcgcaatcgctgctccccggcggtgtgcagttgctgttcatcgagggctaccggcccccgtctactgcgccacgcaccccgagtccggtgtcggcgagctcgggccgctcctcgaggccgtcggcaagaccgtgctcgcggtgccggacgcgtacgccaccaccagcgtcgacgtcaccacctggcgagcagaagtgggcagccatcgtcgcgcaccgcggagaggtcgcccgcgcacggtcgctgcccggcatcctcgcccgcctgcccgaagagacccggcgcgccatcatcgcgaccgagtaataacccggatcgcgaccgggccccgccccggacggcccccaccggctcaccgcctgacggcggccaaccacctcctcttctttccccgggcccgaccagccccgtccctgatcggagagccatgacgaccgcatccgtccccggcgagctgcccggcacccgaatgagcgacgaggcgtacggcgccttgcgcgcctcggccgcattgtgggccgggacgtccgtgctgatcaccaaccggcatgggcagatcctggtccagcacgtcgactaccgcgacacgtgcctcctgccgggcggtgccatcgacaagggcgagtcccccgccgactcggctgcccgtgagctcatggaggaagtcggggtctccgcccccgtcgaccggtgcctggccgtcgactgggtctcccccgacagcgtcagcgtccctgccgccatgcgatttcccggcgagatcccgcacgtcttcgacggcggcacctgggacgacgcccaggtcggcgaaatccggctgcccccgagcgagatcaccgcgatcgacttcgtacgaacccgcatgactccccggcctgctctccccgcccgatgcgcgacgcgccctgtccgccctacgggcccgaatcaactccactggcacggcgctcctggagaacggccaacacatcgcccccggggtcttggaccgcctcggcgttctacggaccgcccgcccggcctaccgctacccctgtgcggctgccggatcgccacgctgtgcgaggccacggtgcgagaggcaggccggtcctcatggccggtcgagcacctccaactgggtggccatgaggcggacgatttccgtctggtgccgggccaggaagaagtggccgccggggaagaccctcagcatgaacgggccgtcggtgtgcccggaccaggcggcggcctcctccacggtgaccttcgggtcgtcgtcgccgacgaggcaggtcacggggcaagtcaggggtggccccggttcccaggtgtaggtttcggctgcgcggtagtccgcccggatggccgggaggatcatgcgcaggacgtcctcgtcgcccagcagttgggggtcggtgccgctgaggccgcgcatctcggcgacgaggccgtcgtcgtcgcgcaggtggacggtctcgtcgcggtgcgtggacggggcgcggcggccggaggcgatgagggtggcgggcgtgatgccccgctcctgctccagccgtcgggcgatctcgtaggcgagggaggcgcccatactgtggccgaacagggcgatgggccggtcggtccagggcaggagggcctcgtagaccttgtcggcgagcgccggtacggagtccaggagaggttcggtgcggcggtcctggcggccggggtactgcacgcacagcacgtcgacgctttcgggcatggaccgggacacggggaagtagaagctggcggagccgcccgcgtggggcaggcagaccagccggacgtggctgtcggggcgcgggtggaacctgcgaatccagaggctgttgtgctcggtgagcggggagttcacggagtcgttcctttacggtttcggttcgaccgcccaccgtggcggggcgttcgccgggaggagcagggggcgcgggcgggccgcgcctaccgctcgtcaggaatccgcgatgtcctgcttgatgacgcgctcgatgttccgctctgccagcgccgcgatggtcacgaacgggttgacgccgatgcttccggggatgagtgaaccgtcggtcacgtagaggttcttgtatccggtgacgcggccgtagtcgtcagtggccttgccgaggacgcagccgccgagcgggtggtagcagaagtcgtcggcgaaggccttgatctgcttgccgaagaggtcgtaccggtagatggtggcgttggccttgttgatgcggtcgaagagcgacttcgcggctgcgatcgcaggcgcgttctggtcccgggtccagcgcaggtccgcccggtccttggccgcgtcgtagacgaaggtgccgcgctccgggttcttggtgatggccaggtagaggctgacccaggtctcgacacccgccggcaggggggcgatctcggcgaagacgggggtgtccgggttgtcccagtcgtcgataccgagggcggggatcgacgactgcttggtgcccgtggggttccacatgtggttggcgcgggcggtcatgatgttgccgttggggccccagcccccgccgacctcagggctgaggcccgggagagtgccggtctcgcgggcacgcaggagtagttcggtcgagccgaggctgccggcaccgaggaagaggtggcggcacgaaacctccttggtcccgagcagcttgccgccggtgtccctctgctcgacggtgagcaggtacgtgccgtcgttctgctgacggatcgtcttgacctggtgcaaggtctcgatggtgactttgccggtgcccagagcggccgccaggtagctcttgtcgagtgagaccttgccgtggttgttgccgtagatcacctcggcggccagcgcggacttgggcaccgcgccgtccgcctcacggcgcatgtagtcccagtcgtagacgttgggcacgaaggtggtgctcaggcccgcgttcgaggcctgccggcgcgagacacgcgcgaacgagtaccagtcggtctgctcgaaccagctcttgtcgatgttgttgacccggagggtggagttcgcgcgggggaagtacttggtgtacatctcctcggcgtcgacctggggcagcacctcctcgaagtacgagcgccggggcgtgaccgccatgccaccgttgacgagggaaccgccaccgacaccgcgtcccaggtacacggacatctggtcgaagttgacccggtccagtacacccgcgtagggctcgatgtcccggttggcgaggtcgagccacaggaatgagccgagcggggcctcggtgcgggtcttgaaccagctcgagcgcttgtcgggcttgagcatcccgctgaatacgttgccgtccggaccgggctggttccacagccggcccatctccagcatcagggtggggacccctgcctcgccgaggcgcaaggcggagacggcggcgccgtaaccggtgccgaccacgacggcggggacgaacgtgccgccggaaccactggttgcggtggcagcggccgcccggggggcggcggtgatcgtagtctgccccgcgagtgcggcggcacccaaggccgccacgcctagcatgcggcgccgcgacagaggctggtgtgcaatcacgctgtggctcctgagctcgggagagatgaaagatgaatcggagggtcggccggagtgacacggtccggggcagaacggaccgcatggagaccgcgcacaggccatcgacgaaatccggatcgggcgggctgaccctgtggaggccggcccgggggttcggtcacccgggtacggaagcgggcgttgcggtgcggcccgctcctgggcgcgggaagcgctcaagcgtgcggtcatgcgtccgccgggccgggcaggggaagacgcggccggttcggaccgtcctgcgacccggagcttgtggtacgcgctgatgaggtgcttctcccgtgcgcgcggactcgagccgttccgccaggtgcttgccgggcactgcgtgagcggcgagtccggcgatcctgtgctcgacccgggtgaacgcggccacagcacccgcgcgagcgggcgccgggagggcccgatgcccgctcacttcacgaagtcgtccacgacctcgggcggccaggtgccgaccttgaacacgcccagggagtaggcgcgggagaccagcgcggcgcggttggacactttcagcttccgcagcaggcaggtcacgtggtactcgacaccctgccgactgaggtagaggctcgcggccaaggggacggtggagacgccggcggcgatgccttcgaggatgcgcgcgtccatcgtggagaggatcttcttgcgtttgggcaccacacgcgtctgctcggcgtccccggccgtgggcatcatgaccaggatcgcggtcgtgtcgggcaggccaccgcgcaccgcgaccgcggtgaggggaacggtgaaggcggactcctcgccgggccccacggcgatgacgggcgtgacgaaacggtggttcttcccttcaagtaaattggagaattgacgcaccagcggctgctgcacgctcgggtgcaccacgtcacggaaattgcgaccgcatatgtcctcggacgagccgttgaactgcctgaagaactcctggttcgcctgctggatggtcagggttttatcgagactcgccatacacaggcccggagttgcaggtgccggaatcagcaagagagtgccccccgtcaggaaacttgggcgaaataaattcggaggccggtgagcggccgtgaaggccgtcaacaggggcgtcatcggccctgggaccagcggtatcgccagatgttgaacatcgtgcgtcaccgcccttgcggggtcctggtcgagccgctggcgaccccttgccgtcgcccgccatcgttttccggactcctgtcgaaatccttgccgaacacctgccgctttcttgccaatcgatggatctccagcttggaaggcgccgttcgccatgccaggatccctagaggacggtgtgagaccagccacttcaaaaccgtcggtcagccatatccgcaagcacgatggggaccgttcatgcctttacctccgaccgcgaacgcgtcagccacgacgaccggtcaggctgagctccaactgagcgtcctggggcccatgtcggcgcgactgaacgggcatgacctgccgctcggcccgccacgccggcgaacactgctggccctgctgctcatccgcctcggccgcgtggtgcccaccgaactacttgtcgaggaactgtggggtgacggagcgccccgtcacgccgtcgccacactccagagctatgtctctcatctgcgccggtccctgcacacaaaggcgggaacaggccaaatttcggtgctacgtcatcggacgcccggttacgtcctcgatctcgatcccgaacaggtcgacgcctggcgcttcgagcgtctggtcaccgacggacggcggctgctggagcagcgcgatccgcgcaccgcgcacgcccggctcaccgaggccttggggctgtggcacggctcgccgtacgcggagttcgacagccatcccccgctcagcgacgagtgcacccgactcgaacagatccggctcaccgccgtcgagtcccgcgcggaggcgcggctggccctcggcgcggccgaagaggtcgccgccgatctggacggggaggcgcgccgtcatcccacgcgggagcggctggtcggccacctcatgacggcactgtcccggctcgggcggcaggccgaggcgcttgaggtgtacgagcggacgcgtagtcatctggtcgaggagttcggcgtggacaccgcagccgaactacgccgggtcagaaacgcgatcctgcgcccggggccgggagcgagcgccccctcgaagaagctgtcacccacaccacttgagtccaccagagcgtcacctgtcccgctcgcgatgaacgagagcggtgacgacggagtacagaactccgagggcttcgtgggctcctgggacggtaggactgccgtcacgccccggaggcacggcacgacggtggaaaccaacgacgccaacgggacggacgacgccgacgcggccgtcgaacgcgaggggatcacggggaccggcgcgcgcccggaggcgcgaaccgatgtgccgccgggcacgcgggcggatgccgccggcacgcaagccgggacagcccagtggcggcctgcacccgggccggaacacgagctcgcagccaccccggaagccgggaaatccccggagtccgagtcggggtggacggctgccccttcgccgttcaccggccgcagccaggagctcgaccgcttgacgaccgccgccgcgagcgcggtcgtgggccacggccatgtagccggcgtcctcggccccccaggagtcggaaagacccgcctgctgctcgaacttgcggcacgtctggagagcatggaggcgcccgagaagggctccaggttggaggtggtctggagtcactgcttccccggcgaaggcgtccccgcctactggctgtggactcagatcctgcggcggctgtccgccacccggccggatgcctttcgcgacgcgacggaaccgttcggcgccctgctcgccccactgatgcccgagcggtcggcggcccggaccgaaggccccaaaggggcctccgactggttccaggcccgcttcctcgcccacgacgcggtctgtgaggtgttgctcgccctcgccgggcaacacccgctcgtgctgttcctcgaagatctgcaatgggcggacaccgcctcccttgacctgctcaggctactgagcacccgttgccagggccatccgctcagcatcgtgctcacgacgcggaagttcgaggccgagtcggacgcaacgctgcgccggatggtctccgacgtgttgcgcggccccaggaccgagacgctgcagctctgtgggctttccctgcaggccgtcggcgccctcgtcgaggcacacgcaggctctggtgtggacccgaaggttgtcgaggtgctgcaccggcgcagcggaggcaacccgtacttggtgatgcagcttctctctctcgtgggcgatgcgcgtaaactccgtcgcccggatgcggtcgacgcgctcctggcccacattcccaccggcgtacgcgaggcgctgcgccagcggttcgccgggctgcccgagccggtcctgcgggtgcttcgactgtgcgccgtcatcggcgccgaggtggacaccgacctgttgcaccgcaccgccacgcgggacgagccggtcatcgcgggtcttgagtcggccatccgtgccggcctgctcggggaggacccgcaccacccggggcgactgcacttcgctcacgccctggtccaggagacgctcgtcgacgagctcccccgtgaggaccgccaccgcctgcacgccagggtcgccgacgcgctgagcgcacgcaggcgagggcaagtgcaggacgaggagatcgagcgggtggcacatcacagctggcacgccaggagtgcactgcccgcggccgaggtgttgcctcggctgctgctcgccgcggaacacgccgagcagtccatggcgtacgagcaggtggagatctggctgcgccgcgccgtgcacctggtcggcttcctaccgccggacgatcccgccacagggaggttggaacaggacctgcacatccaactcggccaggtgctcgccaccactcgcggctacggccaccccgaggccgagacggcactgacgcgcggtcgcgccctcagcacggccgcgcatgcccccgaggacccgtcggtactctgggcgctgtgcaccgcgtacctggtcaccgggcgctacgacgcctcgcggcagttctccggcctactgcgggacatctcgcggcagacctgggagcccgtggcggcgctcggtgcgacgtacggcgaaggcatcgtgctgcatgtgcgcggaatgctcccgcaggcactcgccgaactggagcgcggcgtcggcatagcggatcgtttcgccaacaaggatcacgggctgtcgcgaaccttccagcacgacccgcgcgtctcctgccgctcctacaacaccttcacccactggctcctgggacaccggcagaccgccggcgcgcgccgacgtgagttgttgagcctcactcggtacgaaagcaggccgtccgaccgctccttcgcgctgtacgtggacggggtcgtggcggcttgggagggtgacacccgcaccgcactcgcctcgagcgacgaaggcgctcgcgttgcgggcgaacatggacttgtctactggaaggcgatgctgggcgtcgtcaaagggtggggcctggcgcacgcaggagatcacgaagatggcctcgccctcatgcacacctcgctggccgaattgggccagtccaagacgcacatacgccacccgctccacctgggcctgttgggccaggcgcaacatcacggcgggcggatcgaggaggcgaggaccaccttccggaagctgctggccgccgtcgaacaacgccgcgagcgcgtgtacctccacccggcactgcccgcgaccccgctgctccacgaactgctgggccacggtgccgacgaggcgctcacggaccggggcccaggacgggacgggcccaactccggccgacgagcgtgatggatccgtgctctgcctcgtcagttgcggacccacgccttacggccgatgccgctcagtcctcgaagatcgcgaccgcctgcacgggacaggccatggggacgtcgtgcactcgcgggtcccccgccccgtcctcatgtcccgggaccagggcgaccagcgcgtcgtcgtcctgagtgaaaacgccgggtgcggtcatggcgcactggccggagccgatgcaccggtcgcggtcgatggtgatgcgcatggcgtggcccgcctcccttccttccgttccttccgcccggatcctcaccagacgacggggagctcgatcgggccctgagcgtcgtgtccggccttgatgggcacctcgtccagggggaccgccagccgcaggccggggatgcgggcgaagagcccgccgagggcgatctcgagctcggcgcgggcgagattctgccccaggcactgatggatgccgtggccgaagccgacgtggtgacgtgcgttgcgccgggcgtcgaagatgtcggggttctcgtacgccttggcgtcgcggttcatcagcgtgatggagaccagcaccgcgtctccggccttgatcgtcgcgccgccgacctcgatgtcctccttggccatccggacgatgtggtcggagacggaggtgaaccgcagcagttcttccaccactcctgagaccgcaccggggtcgcgcagcagcacgtcgatctgctcggggtgctggatgagcgtgagggctccgagggcgatggcgttgacggtggtctcgtggccggccaccagcagaaccagcgcgatcatgaccacctcgtcgtggtccaggtcgccctcctccaactggcgtgcgatcagctcgtccagcagaccgtcctcgggctcggcctgcttcctgccgaccaggccgtgaagatacgtgtacagctcgccgaaagccgcgtcggcctccgccgacgtcgcggcgcccacgaagttgcgggagcactcctcgaagaagtcgtggtcgccgtacgggacgccgaggagctcacagatcgccacggagggcaccggcagggcgaaggccgacaccaggtctgcgcccggccctttcgccagcatgtcgtccaagagccggtcgacgaggctctgaagcctggggcggatggcgttcatgcgcttgacgccgaagctggggatcagcatgcgccgctgccgggcgtgcacggggtcgtcgacaccgatcagggggaaggcgagcccgccgcggtcctcggtgcgccggacgacgacagggaagtccgggtgaccccagtcggaggacagccgaggatcgacgagcagtgcccgtccctcggcatgcccggtgatcagccacgccggtcggccgtcgaacagcgtgacctgcgtcagcgggctctcgccccgccgttcctcgtaggccttcggcggctggtacgggcaggtccggtcctgagggaaggacggcgccggtgacccggtgaggcggatttcggtctcagtcatgtcgtgcctttcgaacatcggcagtgcggcgttcatcggtgcgtgatgggctacgggaaacaggtttcggtccgtcagcaaggccgtgcgcggtccggtcggcacccggccgtccggccccggccccttggtcgggcaagtgggccgctgtcgcgggctcctcggggccccgcggtcgaccggtaagccatcggagtactcggtgaccgaccggacgccggacgcgtgccgggccacggaatacgaaccgtcgccgcgctcggtgacggcggcctcggtgaaggggaccgcgcgccggccgtccggggacacgagcgccgttgcgtcgggccgtggcgtgcggcaagcggcttcgggggcagtcggtgcgagggtcgcggcagcggcgggagggccacggcggcaagaagaccgacgtgctgcggaatctcgatgtccggcggctgtgcgccccgaagcacgtcaggcgctggtgtcggcggccgtggccgcccccgacgcgaggcggcgacggaaggcgtgatcagcgcacgtggtccgcgggcgctgatctcctgcgggagtgggccgtggtgcggaggtcaccaggtgacgggcagctcgtgcacgccgtagaagaccatgtcgtggcggaagcgcagttcctcgacgggcttggccaagcgcagacccgggaggcggcggaacagggtctcgaagacgatctgcagctcgatccgggcgagttgctgcccgatgcactggtgtgcgccgaagccgaaggccagatgcggggcggggcgtcgagtgatgtcgaaacgttccggctcctccacgaaggcggggtcgaagtcggcggcgaggacgtgcgcgacgacctgctcgcccttggcgatgcgcaccccaccgagctccacgtcccgggtggcgacgcgctcgccgccgaactggccgatggtgaggtagcgcagcagctcctcgacggcgttgccgaccagcgacgggtcctcgcgcagcagggccagctggtcggggctgtcgaggagcagcgccgtaccgaggccgatcatgcaggcggtggtgtcgtgggccgctatcagcagggtgccggccgcgttcatgagaaacatgtcgtcgaccacaccatcggggtcctcggtggtgatcagcgccgagatcaggtcgtcaccggggttggcccggcgctcctggacaagctggtagagcagcccgcccaggcgcatgccggcggcctcggtggcggcggcgtcctggtcgacccgcatcatcgcctcggcgatgtcctggaactccgcccggcgctcgaccgggacaccgaacaggtcggaaatcaccatggacggcaccgcgttggcgaaggtcttcaccaggtcgaccgggccgccccgcgcctcgatggcatcgaggtgctcgtcgacgatgcgctggatgttcggccgcagcgcctgcatgcgccgtacggtgaactccttggcgagcagcttgcggtccgaggtgtgctccggctcgtcctgccacaacaggctgccgcggccgggcttctgggtgacgacgccgtcctgggtgtgcagtgcgtggggcacctggacgctgaacgaggagtcgcgcagcagggcgcgcacctcctcgtaaccggtcaccagccacgcctcgtggccgctggtgaaggtggcccgggtcaccggggcggcggcccggatgtcggcgataccgtccggcggcaggaacgggcagctgcgggccttggggacggtgggcgcgtcggcggtgggctcgggcatgactctccttgcgcttgtgggaggtgggttcgtacgacggggacggtcaggcggcggcgagttcgagcgcgatctcgccgcgccgaggcgcgttcacgaggacggccatgttcccgggggggtgcacgttgtcgtgcatcatctggtgcatgcgcccgatgtcctggaagccgtcgcagacggacagacaggggtcgagcatgccggcgccgacgaggttgatgacctcgcggcactggcgagtgtcggcgtagtgcgagccctggaggcgcttggagcgcatccacaggtggcgcaggtcgacgtctccgttgtagccggaggtgccaccgcagatcaccaccatgccggcgttgtcgcacaggtacatcgaggtcggcaggctgtcctggccgctgtgctccagcacgatccgcggggacttgcgctcaccgaggatctcccagaccttcttgccgaccccgcgagcgccgcgcaggaaccgcgccgacgcctcggcgtccccggcatcgggcagtcggccccaatgatcgaagtcgcgacggttgacggtgcccgccgccccgagacggcggcagtactcggagcggtcctcgctggagaccacggcgatcggaatgccgccggccagcctgacgagctggatggccatcgagccgaggccgcccgcaccaccccagatcaggacggggtcgccggggcggaccgtgttgccctgccagccgaacagctgccggtaggcggtgggcccggtgagcaggaaggccgccgactcctcccatgacagatgggcgggcttggggtggcactggtattcgtcgacacggcagaactgcgcgaaggaaccgtagttggtctcgtacccccaggccttgatgctctccgagaccagtggatccgtgcccatccggatgtccgcggcggcctcgtcccactggccgctggtgagcagcacgtggtcccccaccgtgacgctgcggacgccctcgccgacggcccacaccacgccggaggcctccgagcctccgatgtggaagtcctcgggctggccctggcgctgccgcatcccgatgacgtcgaccggctcgcccagcgaggaccacacgttgttgtagttgatgccggcggccatcacgtagaccagcacctggccccgacccaccgcgggggtgtcgacgacctcggtgcggaacgcctgcttcggctctccgaagcggttctggcggatcaccgaggcatacatctgccgcgggacctcaccgagcggcggtgtctcgcctatctcgtagagagctttcgtcatgattcctctcccacatctgctctgtccgggtctggggtactcgcggtggacgcgggccggtcatgcggtcgttgcgtccgcaggtgctacggggccggacgcatcggtgacggcgtccgccagccaggaatccaccgccgccgcggtggtgccggcgtggtcctccaacatcgagtagtggtttccggtcacttcgacgatcgtgtccacgtgctcgggcggtgccgcgcgcccgtcaccgtcaccggcgccggccagcatgggctcgctcgcccgtacgagcagggtcggcgcggcgatctgcggcgcggcccagtcgtcgaacaggcgcatatagcggcccatcgcggtgagctgttcgccgccggacctcatgaagtccaggcgctgcgagtgcgcctgggccatcgcgttgagcacctggtggtcgaaggggacctcgcggctgaagctgtcgaccatcaccacggccgccggccgctcccccatggcttccaggtgtgccgccacgccgtgggcgatccagccgcccgaggagtagccgagcaggacggccggctttccgccggcacactcccgtacggtctgcgcgtgcagccggaacacgacgtccgggtcggacgggaccggctcgcccttctcgtagccggggtggaccagcgcccacacgtccagccggtcgcggaagggtgcggcgaaccgcgcgtactggtgcgccccggccggtacgacgtacggcgagaagcacatcagcgcgaggggatggtcgccttgcgacaaccgcaccggggcgggccgccggtccagttcctcgggccgctcgaacgacggccggaagcgggccgcctccatcagcatccccatggcctcggcggccgtcccgttctcgctcgcgtgccggtagagctggaccagcatgtcggcgggccgttcctccgccgcggcgctgccggtgctctggagccgcgtcaacaggtgcttggcgagcctggcgggcgtgggatggtcgaaggccagtccggagggcaggcgcagaccggtcgccgccgacagtcgccgacgcaggtcgatcgcggtgagcgagtcgaagccgagctccaggaagtgcgcggtgggcagcacgtcctcggccgacgcgtgcccgaggaccacggcgctctgggcgcggacgtgttccagcagccgctcctcctgctcgaccggggcgagagcggcgagctcggtcgccagcgccgctccggcgctggtcccctcgccgacggcctgctcggcctccaggagccgctgtacgtcgggcaggtcggccagcagcgggctgggccgtcccacggtgaaggcgggcaggaacttctcccagtcgatcggggcgacggtgagggccgcctcgtcgtgctcgacggcctcgcgcagcgcggagatcgcgagctcgggggccatgacgcccaggccccgccgctcgccgcgctcctggaccgcgtcgtcgaccatgccgccgcccgcccagccgccccaggcgaccgaggtcgcggtcaagccgcgggcccgccgccgcagtgccagggcgtcgaggaaggcgttggcggaggcgtaggaggcctgcccaccgctgccccagacgccggcaccggaggcgaagaggacgaaggcgtccagctcacggccgtcgagcaactcgtcgaggtggatggcgccggtgaccttggaggccgcggcttcggcgaactcgtcgagaccggcgtcggccagcatggacgaccgtgccgtgccggcggcgtgcagcaccgcggtgagcgggtgccgggactcgatgccggcgagtagccgcgcgaccgcagcgcggtcggccatgtcgcaggcggcgatggtcacttcggcgcccagggcggtcagctccgcgtgcagttcctgcgcaccgggggcgtcaggcccgctcctgctggtgagcaccaagtgttgcgcgcccgcgccggccagccaacgggccaggtgccggcccacgccgccggttccgccggtaatcaggacggtgccgcgaggcttccacggtgtcgcggactcctcgtcggcgggccgcgcccggaccatgcgccggccgtacacgccgtcgacacgcacggcgagttgatcctcgtcgtgctgggccagcactccggccaggcggcgcagcgcgtgctcgtccagctcctcgggcaggtcgacgagaccgccccaacgccggggcagttccagtgcggcgacgacgcccaggccccagagctgtgcctggccggcgtcgcgcagtgggtcggtgactccggtggacacggctccgcgggtcgcacaccacagcggtgcctggacgtccacgtcgcccagcgcctgcagcagggtgacggtcgtggcgaggctcgcggacaacgtggggtgggccgggtggcagccgggggcgaggccgagcatcgacaagacaccggcgggctgttcgccgcggagttcctcggcgagccgcttcgcggcctgcgatcggtcgcagtcgacagggagttcgacgacccgcaccttggcgccatgggcggcgagcacgccgacgacgcagggcgcccactgctcgtccgccagtccggcggggaggacagcgagccacagaccgttcaggccgggggccgcgtggtcggtcagtcgccggaaggagacgcggtagcgccagccgtccaccgtggacttctcgcggctgcgccgacgccacgcggacagtaccggcagcgccgggccgacgagggcggcgtcgtccgccccgagttcatcggcgagcccggagaggtccgtgttctccacgagctcccagaatccggcctcgaccggatcggtgcccgcaggcaccgggtcggcgctctccagccagtaccgctgtggctggaacgcgtacgtcggcaagtccacgcgccgtaccggacgcccggcaaagggggccgtcaggtccacgtgcacgccactcacgtgcagttcggacacggagcgcaggaagcggtccatgccgccctggcccctgcgcagcgaggagccggtcacggcgtcggcaccggtctcctccgcgatctcctgcaccgcgtcggccagcagcgggtgcgggctgcactcgacgaacaccccgtgcccgtccgccagcagcgtccgtacggtccattcgaactccaccgtgtgcctggcgttgcggtaccagtactcggcgtcgagggtggtggtgtccagcaccgtgccggtcaccgtggagtagtacgggacctccgccgcgcccggcgcgaccggggccaacaggtggagcagttcggggcgcaggctctcgacctgggtggagtgcccggcgccggtggcgccgcggaccttgcgcacgcgcacgccctcggcttcgagttccgccaggagttcgtcgaccgcgtcgggctctccggagacggtcagggccgcgggcccgttcacggcggcgaccgacagccggtccccgtacttctccagcctcgctcggacccgttcggccggcatggcgatcgcgagcatcgcgcccttgccgatgagcttggtcagcgagcggctgcgcagggccacgatccgcgccgcgtcgtccagcgtcagcgcgcccgcgacgtacgcggcggcgacctcgccctgcgagtggccgacgacggcggcaggcgtcacaccgtaggagcgccacagggcggccagcgacaccatcaccgtgaacagcgcgggttgggcgacctccacgtcggccacgtccggcgcatcgggctcggcgcgcaggacgtcgagcaacggccagtcgaggtagggggcgaacgcctcggcgcaggccttggcctgctcggcgaagaccggggaagtgtccagcagttcacgcgccatctcggtccactgcgagccgtgaccggggaagacgaaggcgaccttgccggaggccgaggcggtgccctggaccacggtgtccgcgggtttgccgtcggcgagcgccgcgagcccggcccgcagctcgtgccggtcctggccgacgaccacggcccgctgctccagttgcgtccgcgtggtgacgagggcgcggccgacgtcgggcagggtgagcccttcggtgcggtcgaggtggttcagcagccggcgcgcctgttcgcgcagggaccggtcggtcttcgcggacagcgcccacgggaacacgtccaggggctgggcggcggtcgcgtcctgcgctgcggggggctgctcgacctcggcggcggtcgcggtctgcggggcctgctcgatgatggtgtgcacgttggtgccgctcatcccgaacgaggagacggccgcacgccgtggcctgtcctggtcgggccaggcggtctgctcggtgagcaggcgcacgtttcctccggcccagtcgacgtgcggggtcggctcatcgacgtgcagcgtctgcggcaggatgccgttgcggatggccatcaccatcttgatgacgccgccgacgccggcggccgcctgcgtgtggccgatgttggacttcagcgagccgagccacagcggacggccctcggaacgctccttgccgtacgtcgccagcagggcctgtgcctcgatcgggtcgccgagccgggttccggtgccgtgggcctcgacggcgtccacttcgtccggggcgagccgggcattggccagcgcctgccggatgacctgctgctgggccttgccgctgggcgcggtcaggccgttggacgcgccgtcctggttgaccgcgctgccccgcacgacggccaggacctcgtgcccgttgcggcgggcgtcggacagccgctccagcagcaccaggcccacgccttcggcgaagccggtgccgtcggcggacgaggagaacgccttgcagcggccgtcggcggacagcgcgcgctgtcggctcgacatcgtgaacgcggacggtccggccatcaccatcacgccgccggccagtgccatggagcactcgccgccccgcagcgcctgcatggcgaggtggagggcggtcagcgaggacgagcacgcggtgtcgacggtgaccgacgggccctgcaggccgaaggtgtaggagagccggccggagatcacgctggccgcgttgccgctggggatgtagccctcgacgccgtcgggcaccttgagcgggcggccggtgtagtcctggtagccggagccgacgaagacgcccgtggtggtggagcgcatcgcgtggggggcgatccgggcgcgctcgaaggcctcccaggtggtgtccagcagcaggcgctgctgggggtccatggcgacggcctcgcgcgggctgattccgaagaccgcggggtcgaactcgtccgcgtcgtgcaggaatccgccctgggtggtgtacgtggtgccggggtggtcggggtccgggtggtagagcgcctcgacgtcccagccacggttgccggggaagcgggagatcgcgtcgcggccggaggcgaccagctcccacaggtcctcgggcgagcgcacgccgccggggtagcggcaggccatcccgatgatggcgatcggctcgtccagcaccgctgcggtcgcggccgccgcgaccgcctcgtgttggccaccggtgagttcggcgagcaggtgggcggcgaggtccgcggccgtggggtggtcgaagatcagcgtcgcgggcagggagaggccggtggccttgttgatccggttgcggagttccaccgcggtcagggagtcgaagccgatgtcccggaagggccggtcggcctcgacggcgcccgccccgcggtggccgaggacggcggcggcgtgcgtgcgcacgaggtccacgagggcgcgtgcgcggtcttggtgcgacagcgcggccaggctctcggcgagcgcaccggagccgtggcccgccgcgggggtgtccaccgcgagcgccgcgcgcacctcggggaggtcgccgagcagcgggctgggtcggccgagggtgaacggcacgatgaagcgcgaccagtccacgtcggccacggtcagcagggtctcgtcgcggtccagcgcgcgctgcagggaggtgatcgccgatgcgggggtcatcgcgcggaggccgcggcggcgcagccgctcctcgtcgtcgccgtccgcgaccatgccgccgtcggcccaggggccccaggagaccgcggtcgcggtgaggccgcggtcccggcgctgccgggcgagaccgtcgaggaaggcgttgccggcggcgtaggcggcctggccgccgctgccccagacaccggagatggaggagaagaggacgaaggcgtcgagctcctgatcgcccagcagctcgtccaggtgggccgcgccgccgaccttggcggcgagcgcggcggcgaaggcagcgggggtggtggcgtccaccgtgccggcgtcggcgaccccggcggcgtgtacgacggcggtgaagacgtgctgggcgagcagggccgctacggcgtcgcggtcggccacgtcgcaggcggcgaacgtgacgcgggcgccgaggacctccagctcgtcccgcagagcggcggcgcccggggcgtccgcgccccggcggctggtgaggacgaggtgttcggcgccgccgcgcgccagccagcgggcgacgtggccgcccagcgcgcccgtaccaccggtgatgaggacggtgccgcgaggctgccagcggcgggtggccgcccgtgccggtgcgtgggcgagccgccgggcgaagacaccggaggcgcggacagcgagctggtcctcctcccaccggcccgtcagcgcctgttccagcacgtcggccaggcgtacggcggcctggtcgtcgacggactccggcaggtcgatcaggccgccccagcgccggggaagctccagggcgacggtgcggcccaggccccagacctgggcgtgccgggcgtcgcgtacggcgtcggagccgctcacggccaccgcgcccgaggtgaggcaccacagcggggcgtcgacgcccgcgtcgcccagggcctggacgagcagcagggtgggcagcacggggtcgccgttgacgagcagggacagcacgccgtcgaccggcccgattccggcaagctccccggcgagaccggcgcggtggctcgccgcgtcgacgaccagcgtcttcagagtggcgccgcgggcggtgagcgcggtgcggaccgcggcggtctgctcgttctcctccgccggcacggccaacagccaggtgccgccgatgccggccggaccgagctcgcccaggcgcttccacgactcgcggtagcgccggtcgtcgacggtggactgctccttgcgctgccgccgccacgacgacagcctcggcagcacgtcaccgaacgtgtcccctgcgccgatgtccagggtctcggcgagggcctgcaggtccccgcgctccacggtctcccagaactccgcgtccaccgggtccgcttcggcggcggcggattccggggcgtcgacccagtaccactcgcgctggaaggcgtaggtcggcaggtcggtcctgcgcgcgccggcgaagaacgagtgccagtccacggacacgccgtgcgtgtgcagatgggccagcgcggtcacgacggcctgccgctcggggcggtcggcccggagtacggggacggtgacgatgtcgtccgcacagccctgtgccatgccgctcagcacaccgcccggaccgatctcgatgaaggtcttcacgcccaggtcgtgcagggtgcggacgctgtcggcgaagcggacggtctcgcgcacgtgccggacccagtactcgggggtgtaagcctcgacaggctgacccgtgaggttggagacgacggggagctgcggctgctcgaaggccaggccacggacgacctcggcgaactccgccagcatcgggtccatcagcggcgagtggaacgcgtgactgaccttcagccgggacgtcttacggccctgctcggcgaagcccgcggcaatcgccagggccgccgtctcgtcacccgaaaccaccaccgacgacgggccgttgaccgcggcaatgctcaccccgtcggtgaggtggggcaggacttcctcttcggtggcctgcacggcgaccatcgcgccgcccgcgggcagggcctgcatcagcgcggcccgcgcggacaccagcttcgccgcgtcgtcgagggacaacgcaccggccacgtgcgcggcggcgatctcgcccacggagtggcccacgacgaagtcgggccgtacgcctaaggattcgaggagccggaacagggccacctcgaccgcgaagagcgcgggctgggtgcccccggtccggtgaagcgtttcggcatcgacgtcgaccggggcatccaggtgcgcgcacacctcgtcgtaggccgcggcgaagacggggtacgccgcgtacagctcgcgccccatgccgatgcgctgcgagccctgcccggagaagaggaagccggtcttgccgccggccgggcgccccagcagcacacgggacgaaggggtcccggtggccaggtcctcgagcccgctgaggagttcctcccggttgtcccccacgaccgcggcccggtgacgcatggcggcgcgggtcgtggccagcgacagcccgatgtcctgcggccggacctcgccccgtgccgaaggccgcagccgggccgcctgggcccgcagcgccgcgtcgctcctggcggagagcacccacgccagggggccgtcgacgagagcccctgcgggcccctcgtcctgggccggcggggcctgttcgatgatggtgtgggcgttggtgccgctgacgccgaaggacgacacggcggcccgacgcgggtgatgggtctccggccactccacggcctcggtcagcagccgcaccgcgcccgccgaccagtccacgtgcggcgtcggctcgtccacatgcagggtctgcgggagcactccgtggcgcatggccatgaccatcttgatgatgccgccgacacccgcggccgcctgcgagtgaccgatgttggacttcagcgagcccaaccacagcggccggtcctccgtccgctcccggccgtaggtggcgaggagcgcctgcgcctcgatcgggtcgcccagcgtcgtgcccgtgccgtgcgcctcgacgacgtcgatctgggcgggagacaggccggccgatgccagggcctggcggatgacccgttgctgcgcggggccgttcggcgcggtcagaccgttggacgcaccgtcctggttcacggcgctcccccgtaccaccgcaaggacctcgtggccgttgcgcacggcgtcggacagccgctcgaccaggagcatgccgacgccctcggcccagccggtgccgtcggcgccggcaccgaacgccttgcaccgcccgtcaggggccagcccgcgctggcgactgaactccacgaacgcggtaggcgtggtcatcacctgcacgccgccggccaacgccatggaacactcgccgttacggagggcctggatcgcccagtgcagggccacgagcgacgacgagcacgccgtgtccacggtgacggccgggccctccaggccgaaggtgtaggcgatacgaccggacatcacactggcggagttgccggtcccgagatgaccgtcggactcgccacccaccccgaccaggaggttgacgtagtcctggtagccggagccgacgaagactccggtacggctgccgcgcaccgactccgcgtcgatgccggcccgctcgaacgtctcccacgtggtctccagcagcaggcgctgctgcggatccatcgccacggcctcccgcgggctgatcccgaagaaccccgggtcgaactcccccgcctcgtacaggaatccaccgcgacgcgcgtacgtcttccccctcgcatccgggtccgggtcgtagatgccctcaacgtcccaaccccgatccgccgggaagtccccgaccgcgtcaccaccggcggccaccaggtgccacaggtcctccggcgaacgcaccccgcccggataccggcacgccataccgacgatcgcgatggggtcgtcgtccttctcctcgacctcacgaaggcgctcacgcacctgacgaaggtccccggtgacgcgcttgagatactcgagaagcctgtcttctttgctgctcatccgcctcatccgtcctcggctgtcgttaaaggtagagcgccaagaactaggaaatttctagatcttgatcgatcagatcgaaaatgtcgtcgatcgtcgcgtcctggagctgtcgctgcgcatcggcggattccgcgccttgctctccggcggagttcaccagggacagcagttcctgcagccgcctccgcacccccgaccggaccgtctgctcggccgaggcggccgtcgagatcaccgactccagccggtcgagctcgctgaagaccgacacctcctccgggcccgtctcgtcggcgagttcgctccgcaggtagcgggcgatcgcctcgggcgtcgggtggtcgaagaccagcgtcgcgggcagggtcaggccggtgtcggcactgagcaggttgcgcagctccaccgcggtcagggagtcgaagccgaggtcccggaacgccaggtccggatccaccgccgcggagccgctgtggccgagcacggccgccgcgtgcgcgcacaccgtgtccacgagcaggcgttgccgttcgccttcggacagtgtggacagcttcgccttgagcgcggacggctccgcggctcgctcggtgcgcttctccgcgagggcgtccccgacctcgggcaggtcgctcagcagcgcgctcggcctgccgatggtgaacgggacgacgaaccgctcccagtccacgtcggccacggtgaccgtgccgtcgccgccgctcagcgcaccgtgcagcgcggagatcgcccggtccggccgcagcacgctcagacctcgctgccgcagccgctcctcgtccccggcgtcggcgaccatgccgccctcgccccacgggccccaggcgatcgcggtcgccgcgaggccgcgggcccgccggtgctgcgccaggccgtcgaggaaggcgttcgcggccgagtacgcggcctgcccgccgcctccccacacgccggagatggaggagaagaggacgaacgcgtccagctcctgatcgccgagcagttcgtggaggtgcacggccccgagggccttcgcggcgaccgtcgccgcgaagtcgccgaggctcgtctcggcgagcatgcccgcctcggcggtgccggccgtgtggacgacggcgttcaccgggtgctcggcgagcagcacggccagcgcctcacggtcggccacgtcgcacgcggcgacggtcacgcgtacgcccgcctcctccagctcggccttgaggccggcggcgccgggcgccgcggggccgcggcggctggtgagcaccaggtgctccgcacccgcaccggcgagccagcgggcgacgtgcccgcccagcgcacccgtaccaccggtgatcaggacggtgccgcgcggcgaccacgaacgctcgctcagggctgcgggcagacgcgacaggcgccgcacgaacagcccgcggtcgcggatcgcgacctggtcctcggccgactggccgagcaccgcggcgagtcggccggcgatccggtcgtcgaccgtgtccgggaggtcgatcagaccgccccagcgcggcgcgtgctccagcgccgccacccggcccagaccccagacctgggactggtacgggtccgtcgcctcgtcggcggtgctcacgcccaccgcgttccgggtcacgcaccacagcggggctccgatgcccgcgtcgccgagggcctggacgagcaggacggacagcgcgacgccgacggtcagtgcggcggctgccggggcggccccgcagtcgacggcgagcagcgacaggacgcccgccacggtttcgtcaccggccgctcgggtgagctgcgcggccaggtcctcacggccggtggccggctcgaccgggaccggcagcggggccaggccacgctcggtcagcccgcggaggcaggcggtgacccaatcgtcgccgagttgcgcagcgctgaccggaaccagccatagaccgatccgggcagggccctccgggacgcggtcgggtatccctttccacgactcgccgtagcgccaggtgtccacggtggattgctccttgcgctgccgccgccacgacgacagcctcggcagtacgtcaccgaacttgtcccctgcaccgacgccgagggtctcggcgagggcctgcaggtccccgcgctccacggtctcccagaactccgcgtccaccggttccgcttcggcggcggcagcgatttgcggggcgtcgacccagtacggctcgtgctggaaggcgtaggtcggcaggtcggccttccgcgcaccggcgaagaacacgttccagtccacggacatgccgtgcgtgtgcagatgggccagggccgtcacgacggcctgctgctcggggcggtcaccgcgcaggacgggcacggtgacggcctcgtccacgcagtcctgcaccatgccgctgaggacgccgccggggccgatctccacgaacgtggtcacgcccagctcgccgagggtctcgatgccgtcggcgaagcgcaccgcttcgcgcacgtgccggacccagtactccggggagtacggctcggccaggcgcccagtgaggttggagaccaccgggacctgcggctgatggaacgtcagaccgcggacgacctccgcgaactcctccagcatcgggtccatcagcggcgagtggaacgcgtgactgaccttcaaccgggaggtcttgcggccctgtcgggtgaagacctcggcgatctccagcacggcatcctcggctccggagaccacgacggaccgcggaccgttgatggccgccatgccaacgccatcggtcaggtgcggcaacacctcgtcctcagtggcctggaccgcgaccatcgcaccgcccgcgggcagggcctgcatcaacgcggcccgcgcggacaccagcttcaccgcgtcgtccagcgacagcaccccggccacatgaacagccgcgatctcaccgaccgagtgaccggccacgtaatccggccgcacaccccacgattcgagcagccggaacagcgccacctcgaccgcgaagagcgcgggctgggcgcacccggtccgatgcagggtctcggcgtcgacgtcgaccggcgcctccagacgcgcacacacctcgtcgtacgcatcggcgaagaccgggaacgcctcatacaactcacgccccataccgatccgctgcgaaccctgacccgagaacagaaaaccgaccttgcctcccggccggccctggacgactccgggcgagggcattccggcggccagggatcccagtccgcggcggaagccgtcaccgctctcgccgatcactgccgccctgtggcgcagggcgctccgggtggtggccagcgagaagccgacatcggccagtgacatgccgtcctccacgaaggccagcagtcgtcgtgcctgatcccgcagcgcagcgctgctcttggcggagagcacccacggcaggagggccggggccggagtgacggtggcctcttcggccgggaccggcggggcctgttcgatgatcgtgtgggcgttcgtgccgctgacgccgaaggacgacacggcagcacggcgcgggcgctccgactcgggccatgcgacggcctccgtcagcagccgcacgtcaccggccgaccagtccacatgcggcgtgggttcatcgacgtgcaaagtctgcgggagcactccgtgacgcatggccatgaccatcttgatcacacctgccacacccgccgcggcctgcgtgtggccgatgttggacttcagcgaccccagccacagcggctgtcctgcgggccgctcctggccgtacgtggcgagcagcgcctgcgcctcgatcgggtcacccagcctcgtccccgtaccgtgcgcctccaccgcgtcgatgtcggcggcggtgaggcccgcggaagtgagcgcctggcggatgacccgctgctgcgccggaccgttcggcgcggtcagaccgttggacgcaccgtcctggttcacggcgctgccgcggacgacggccaacacctggtgcccgttgcggcgggcgtcggacagccgctcgaccaggagcatgccgacgccctcggcccagccggtgccgtccgcgtccgcgccgaacgccttgcaccgcccgtcaggggccagcccgcgctggcggctgaactccacgaaggcacgcggggtggacatgaccatcacgccgccggccagcgccatggagcactcgccgttacggagggcctggatcgcccagtgcagggccacgagcgacgacgagcacgccgtgtccacggtgacggccgggccctccaggccgaaggtgtaggcgatacggccagacatgatgctcgccgagttgcccgtgccgaagaagccctcggaatcgtctatcgcgttgaaggcccgggcggcgtagtcctggtagccggagccgacgaagactccggtacggctgccgcgcaccgactccgcgtcgatgccggcccgctcgaacgtctcccacgtggtctccagcagcaggcgctgctgcggatccatcgccacggcctcccgcgggctgatcccgaagaaccccgggtcgaactcccccgcctcgtacaggaatccaccgcgacgcgcgtacgtcttccccctcgcatccgggtccgggtcgtagatgtcctccacgtcccagccgcggtccgccgggaagtcgccgaccgcgtcaccaccggccgccaccaggtgccacaggtcctccggtgaacgcaccccgcccggataccggcacgccataccgacaatcgcgatgggctcctcgtcctcggcgggcgcggcggccgcttccggagcggccgcgatggtgaggccggtgagctcggtgcgcagctgccgggcgagtgcctgggcgttggggtggtcgaagaccagcgtggggggcagtgcgaggccggtctcggctttgagcttgttgcgcagttctacggcggtcagggagtcgaagcccaagtccttgaaggctcggtcggcctcgacctcgccggcgttgttgtggccgaggacggccgccgcgtgtgtgcggacgagatcgaccagcagcgcgtgctgctcggtctcgggcatcctggcgaggcggtcggccaggggcgaggcggcggccgtgccgggcccgccggcggtgctgtccgcggtgaggatccgctcggcctccgggaggtccccgagcagggcgctcgggcggcccacggtgaacgggggcaggaaccgctcccagtcgacgtcggccactgttgcggtcgcctcgccggagtccagcgcccgccggagcccggccacggcgagcgcggcgggcatcgggatcaggccgcggcggcgcagtcgttcgtccgcgccgtcggcctcggccatgccgccgccggcccacgggccccaggccacggcggtcgccggcaggccttgggcccggcggcgttcggcgagtccgtcgagcagggcgttggccgccgcgtaggcggcctggtggccgctgccccacacgccggcgatggaggagaagaggacgaaggcgtcgagttcctggccggcgaggagcgcgtcgaggtgcagggcgccggcagccttggcggacagcacatcggcgcaggcgcccggcgtcatggcctccagcggctccatgtggtccacgcccgccgtgtggacgactgcgttcaccgggtgctcggcgagcagcgcggcgagcgcctcacggtcggcgacgtcgcacgcggcgacggtgacacggacacccgtcgcctccagctctgcgacgagacccgccgcgcccggcgcgtcggggccgcggcggctggtgagcaccaggtgttcggcaccggcaccggcgagccagcgggcgacgtgcccgcccagcgcacccgtaccgccggtgatcagcacggtgccgcgcggcgaccacccctgggcggcccgggtgttccggcgggcggcggtgtgggacagcctgcgaccgaacacgccgcggtcgcggatcgcgacctggtcctcggccgactgggcgagcaccgcggccagtcggccggcgatccggtcgtcaaccgtgtccgggaggtcgatcagaccgccccagcgcggcgcgtgctccagcgccgccacccggcccagaccccagacggcgttctgggcggcgctcggcaccgcgtccgcccggccggtggacatggcggacctggtcagcgcccacagcggggcgtcgatgcccgcgtcgcccagggcctggacgagcgcgagggtcagcacggtgccgacggacagagccgggtgtccggcgtggtgcctctcgtcgatgccgagcagggagatcacaccgtcgagcgggctctcccggacggcctcgccgagctgccgcagcagtgcgccgcggtcggcggccgggtcgaccgtcacccggaccagccgggccccacgggcggcgagcccgtcggcgacggcggcggtccactcgaaggcctcgaaggcctcggtgtcctcggtgaccaggaacagccagttgccccgcagttcgtgcgcccggaggccgctgagcggcttccagcccgtgcggtaggaccagccttccacggcggactcccggcgctgctgccggcgccacgcggacagccggggcagcaccgcgtccagttgctcgacgggcagttcgagggtggcggcgagggactgggcgtcctcgcgctccacggtctcccagaacccggtctccacggcgtcggtccccgcggcggccgtgggcgcggtggtctccagccagtaccgctggtgctggaaggcgtaggtgggcaggtcggcgcgccgggcgccgcggccggcgaagaacgcccgccagtcgacggggacgccgtgcacgtggagctgcgcgagagcgccggtgatcgcctcgggctcggggctgccggaccgggcggatgcaacggcgaccgcgccgtccaggcagccctgggccatggcactcagcaccgcgccggggccggtctccacgaacgtggtcacgcccagctcgcccagggtccggatgccgtcggcgaagcggacggcctcgcggacgtgccggacccaatagtccgccgtgtacgcgtcgatgagctcaccggtgaggttcgagacgaccggtgtccggggcgtctcgaagcgcagaccgccgacgacgcgggcgaagtcctccagcacggggtccatgagcggcgagtggaacgcgtggctcacggtgagccgggaaatcttgcggccctcccgggcgaagaagtccgcgacggcggctacggcgtcctcggttccggagaccacgacggactgcgggccgttgatcgccgcgatgccggcgtcgtcggtgaggtgcggcagcacctcgtcctcggtggcctggacggcgatcatcgccccgccggcgggcagggcctgcatcagcgcggcacgagccgtcaccagtgcggccgcgtcctccagcgccagggccccggccacgtgtgcggccgcgatctcgcccacggagtgcccggccaggtagtccggccgcacgccccacgactccagcaggcggtggacggcgacctcgtgcgcgaacagcgcgggctgcgtgaaggcggtgcggttcagctcctcgccgtcctcgtgaccattctcgccgaaggccacgtcccgcagtggccggtcgaggtgccggtcgaggtgtgcacacacctcgtcgtacgcctccgcgaagaccgggaacgcctcgtacagttgccgccccatgccgatgcgctgcgagccctgcccggagaacaggaatccgacctggccggcgtcggcgcggccgaggacggcgccgggagcgggcgcccccgaggccagggcccgcaggccctcggcgatccggccgtggtcggcaccgaccacggcggcgcggtgctccagggcggcccgggtggtggccagcgagaagccgacgtcggtgagggacggttcggcgccgtcggcggtgagggtcagcaggcgctcggcctgggcgcgcagtgcggcctcggacttgccggacaggacccacggcacggtcgccgaggagacctcgaccggtgcgacggcggccggttcggccaccggggcctgctcgatgatcgtgtgggcgttggtgccgctgacgccgaaggacgagatcgcggcgcggcgcgggcggttcgtatccggccagccgacggcctccgtcagcagccgcaccgcgcccgccgaccagtccacgtgcggcgtcggctcatcagcgtgcagcgtccgcggaaggacgccgtggcgcatcgccatcaccatcttgatcacaccggccacgccggacgccgcctgggcgtgaccgatgttggacttcagcgagcccagccacagcggccggtcctccgggcgctcctgcccgtaggtggcgaggagcgcctgcgcctcgatagggtcacccagagcggtgcccgtgccgtgcgcctccaccgcgtcgacgtcggcctcggtgagcccggcggaggccagggcctgccggatgacccgctgctgcgccgggccgttcggggcggtcagaccgttggacgcgccgtcctggttgaccgcactgccccgcacgaccgcgaggatctcgtggccgttgcgcacggcgtcgctgaggcgctccacgagcaccacgcccacgccctccgcccacccggtgccgtcggcgccggcgccgaacgctttgcaccgtccgtcaggggccagcccgcgctggcggctgaactccacgaacgcagccggtacggccatgacgttcacaccgccggcgacggccatcgtgctctcgccgttgcgcagcgactggatggccaggtgcagggcgaccagcgacgacgagcacgccgtgtcgacggtgacggccgggccctccagtccgaacgagtaggctacgcgcccggagacgacgctcgcggcgctgccggtgagcaggtggccctcgacgccttccgggacctgcgggaggcccgcgccgtagccctggtaggacatgccgacgaacacgccggtgcggctgcccttcagggaggccgggtcgatgcccgcccgctcgaacgcttcccacgaggcctccagcagtaggcgctgctgggggtccatcgcgagcgcctcgcgcggcgagatcccgaacagtgcggcgtcgaagtcgcccgcgtcgtagaggaagccgccgtcgcgcgcgtacgtcttgcccggggtgcccgggtcggggtcgtagagggcctctacgttccagccgcggtcctcggggaagccggagatcacgtcgccgccggacgtcacgagctgccacaggtcctcgggcgagccgacgccgccggggaggcggcagctcatggccacgatcgcgatgggttcgtcgccgacggcggccgtgcgctgctcctgccgcgcggcgccccgcgaaccgagcagttcggcgcgcaggaagcgggccagggccgtggcgttggggtagtcgaagaccagcgtggtaggcagcttcaggccggtgtcggccgtgagcttgttgcgcagttcgacggcgctgagcgagtcgaagccgaggtcgttgaaagcgcggccgggctccaccgccgcggtgccgtcgtggccgagcacggcggccgcgtgcgtgcggacgaggtccaccagcgtgcggtcctgctcggccgccggcagcccggtcagcttcgcggcgagcgcgttgccggcttcggcgccgccgggggccggcgcctccagggcgcggcccgcctcgggcacgtcggagaacagggcgctggggcgggtgacggtgaacgggccgatgaaccgctcccagtcgaagtccgcgacggtgagggcggtctcgccgtcggccagcgcctgctggagcgcggagatcgcgagggcgggccgcatggggggcaggccgcggcggcgcagcatctcctctccgtcgccgacaccggccatgccgccctcggcccagccgccccaggagacggcgagtgcggtgcgcccgtgtgcccgccgatgctcggcgagggcgtccaggtaggcgttggccgccgagtaggcaccctggccggcgccgccccagatgccggcgcccgaggagaacatgacgaacgcgtcgagttcctgaccggccagcagttcgtccaggtgcgtggcacctgcggccttggccgccaccgagccggcgaacccggccgggtcggagtcctcgatcatgacgtggtcgccgacgccggcggcgtggacgacggcgttgacggggtgctgggccagcagcgcccgcagggcgtcacggtcggccgcgtcacaggccacgacggtcgcggccgcgccgagctcctccaactccgcgacgagctccgcggcgccgggcgccgcggggccgcggcggctggtgagcaccaggtgctccgcacccgcaccggcgagccagcgggcgacgtgcccgcccagcgcacccgtaccaccggtgatcagcaccgtgccgcgcggcgaccacccctgggcggggccggtggcgcgggcggcccggacgagccggcgcccgaggacgcccgaggcgcggaccgccacctggtcctcggccgtctgaccgaggacggcggccacgcgggccgcggtgcgggcgtccagcagctcaggaaggtcgagcagtccgccccagcgccgcgggtgttccagcgccgccgcccggccgaagccccacacctgcgactgcagcgggcggtccacgcggtcggagcggccggtggccaccgcgccgcgcgtggcgcaccacagcgggacgtcgacgcccacgtcgccgagcgcctgcaccaggcagagggtcgcggcgaggccgtgcgacaggccggggtcgccggccgaggcgctctcgtcctcggcgagcagggacagcacgccggtcaccgggccgacgccggccagctcgcgggccagcgtcccgcggtcggtgccgggtccggcgacgagcgtcaccagttccaggccgcgctcgtcgagcgcggtgcggaccgaggcggtccactcgctctcgccggccacgacgagcagccaggtcccggacgcgccgggctgagggagcgcgccgagcggcttccaggtgacgcggtagcgccagccgtcgaccacggactgctcgcggcgctgacggcgccatgcggacagccggggcaggatcgcgccgagcgaggcgtccgcgctgacgcccagggtcgcggcgagggactccgcgtcctcgcgctccacgctgtcccagaagccggaatccgccgcgtcggtcggggtgccggcagcggccaggtccccctccccgtccagccagaagcgctcgcgctggaaagcgtaggtgggcagggtgacgcggtgagcgccggggaacagggcctgccagtccggggagacgccgtgcacgtgcagttcggcgagcgcggtgacgacggcctgctgctcggggcggtcaccgcgcaggacgggcacggtgacggcctcgtccacgcagtcctgcaccatgccgctgaggacgccgccggggccgatctccacgaacgtggtcacgcccagctcgccgagggtctcgatgccgtcggcgaagcgcaccgcttcgcgcacgtgccggacccagtactccggggagtacggctcggccaggcgcccagtgaggttggagaccaccgggacctgcggctgatggaacgtcagaccgcggacgacctccgcgaactcctccagcatcgggtccatcagcggcgagtggaacgcgtgactgaccttcaaccgggaggtcttacggccctggccgacgaagacctcggcgattgcggtgaccgcctcgccagcgccggaaagcaccatggaccgcgggccgttgatcgccgcgatgccgacctcgtcggtcaggtgtggcagcacttcctcctcagtggcctggaccgcgaccatcgcgccgccgacgggcagggcctgcatcagcgcggcacgcgccgacaccaacctcacggcgtcgtccaacgacaacaccccggccacatgcgcggccgcgatctcaccgaccgagtgaccggccacgtaatccggccgcacaccccacgattcgagcagccggaacagcgccacctcgaccgcgaagagcgcgggctgagcgcaccccgttcgatgcagggtctcggcgtcgacgtcgaccggcgcctccagacgcgcacacacctcgtcgtacgcatcggcgaagaccgggaacgcctcatacaactcacgccccataccgatccgctgcgaaccctgacccgagaacagaaaaccgaccttgccctcggagcgggctcgtcccagcgtcacgttcgccgccggttgaccggcggcgagggcggtgagggcttgccggagcttgtccgagccctgtgccaggagcaccgcgcggtcctcgaacgtctcgcgggaggccagtgagaggccgatgtcggaagccgtccagccgtcgttcgcgtcgaggtggtcggccagcctggccgcctgagcgcgcagcgccggctcgcccttgcccgacagcacccacggcacgagcgcgccggagtcgggcgtggggggcagctccgccgtggcgggggcctgctcgatgatggtgtgggcgttggtgccgctgacaccgaaggacgagatcgcggcccggcgggggcggtccgactcgggccagtcgacggcctcggtcagcagccggacatcaccggccgaccagtccacgtgcggcgtcggctcgtccgcgtgcagtgtccgcggcaggatgccgtggcgcatcgccatgaccatcttgatcacaccggcgacacccgcggccgcctgcgtgtggccgatgttggacttcaacgagcccagccacaaaggccggtcgccgtcccgtccctggccgtacgtggcgagcagcgcctgcgcctcgatcgggtcacccagcctcgtccccgtaccgtgcgcctccaccgcgtccacgtcacgcggagcgagcccggccgaggccagcgactggtggatcacccgctgctgggccggaccgttcggagcggtcagaccgttggacgcaccgtcctggttcaccgcgctgccgcggacgacggccaacacctggtgcccgttgcggcgggcgtcggacagccgctccaccaggagcatgccgacgccctcggcccagccggtgccgtccgcgtccgcgccgaacgccctgcagcggccgtcgggcgacaggccgcgctggcggctgaactccacgaagacgctcgggccggccatgacggtgacgccgccggccagcgccatcgtgcactcgccgttgcgcagcgactgcatggccaggtgcagggcgaccagggacgacgagcaggccgtgtcgatcgtgacggcgggcccttcgagtccgaaggtgtaggccacccggccggagacgacgctggacgcgccgccgacgagccggtgtccttccacgccttccggcgtgcggcgcacatcggctccgtagccctggtaggccatgccgacgaagacgccggtccggctaccgcgcagctgcgcgggggcgatcccggcccgctcgaaggcctcccacgaggtctccagcatcaggcgctgctgcgggtccatggccagcgcttcacgcggagagatcccgaagaagccggcgtcgaagtcggtggcgccataaaggaatccgccgtcgcgcgcgtacgtcttgcctgggcgatcggggtcggggtcgtagagggcctcgacgtcccagccgcggttcgacgggaactcggagatggcgtcgccgccggacgtcaccaggtcccacagcgcctcgggcgagtcgacgccgccgggcaggtggcagctcatcgccacgatggcgatgggctcgtcgtcggcggccgcgtgctgctcctgctccacgacggcctgcgatccgagcagctcgctctgcaggaagcgggcgagcgccgtggcgttggggtagtcgaagaccagcgtgggcgacagcgcgaggccggtcgccgtgttgaccttgttccggagttcgacggcggtcagggagtcgaagccgagggccttgaaggcccggtcgggctcgacctccgccgccgaggagtggcccagcacggccgcgacgtgcgcgcggaccaggtcgatcagggtgtgtgtgcgctcggcctccggcagtccggcgagccgggccgccaggggcgtggcgccgacgtcggccggcgccgcggtgacggccgctgtgacggcgccggcgcggcgcacttcgggcagctcggacagcagggcgctcgggcggccgaaggtgaacggtccgatgaaccgttcccagtcgatgtcggccacgacgaccgcggtgtcgtcgcagtccagggcgcgctggactgcggtcacggcgagtgcggcgggcagggtgacgacgccgcggcggcgcaggtgcgcttcgtcggcgtcggtgaccatgccgccgtctgcccagggaccccaggcgatcgcggtggcggtcagaccccgggccctgcgccgggcggcgagcccgtcgaggaaggcgttgccggccgcgtaggcggtctgcaggccgctgccccacacgccggcgatcgaggagaagaggacgaatgcgtccagctcgcggtcgcctagcagttcgtccaggtgtgcggcaccgtgggccttcgccgccatcgtgcgggcgaagtcggccggcgtcagctcgtcgaagggggcgaactgttccacgcccgcggcgtggaagacggaggtgaaggtgtgctcggcgagcagcgccgccagcgcgtcgcggtcggcgacgtcgcacacggcgagggtgacgcgcgctcccagctcctccagttcggccttgagcgcggtcgcgccgggcgcgtcggcgccgcggcggctggtgagcaccaggtgttcggctccggcaccggcgagccagcgggcgacgtgcccgcccagcgcacccgtaccaccggtgatcaggacggtaccgcgcggcgaccacggacggccgacgccgcttcgggcatgggcgagccgggcggtgaacacgccggtggcgcggacggcgacctggtcctcctggccgtccgcagcgtcggctccctggctcagtacggcggcgatacggccggcggcgcgctcgtcgacggccgcgggcaggtcgatcaggccgccccagcgccgggcgtgctccagggccagggcacggccgaggccccacacctggttctgcaccgcgctgagcggtgcgtcgtcggagcggccggtggcggccgcgccgcgggtggcgcaccacagcggcgcgtcgacgcccgcgtcgccaagtgcctgggccagggccacgctctgcgcgaagccctgggagagcgcggggtgttcgggcgaggcgatctcgtcggtcgcgagcagggacaggacgccgtcgagcgatccggcttcgcccgcgacccgggtcagctcatcggtcagggacgcgcggtcggcgtcggcgccgaccgtcagcgggatcaggtgcgcgccgcgtccggcgagtgccgtgcggaccgtcccggcccactcgtcaccttcgggcgcggcgaacagccatgtgctgcccgagaggtcgccggcggagaggccgttcagcggctgccaggccagctggtagcgccggccgtccacgacggactgctcgcgccgccggcgccgccaggcggacaacttcggtaccacgacgtccagttcctcggggttcagccccagcgtggcggcgagggactgcgcgtcctcgctctcgacgctcgcccagaactcggcgtcgaccgcgtccacggtggccgtctcggcctcgcgggcctccagccagtagcgctgctgttggaaggcgtacgtgggtaggtcgacacgtcgggcgcccgggaagaaggcgtgccagtccaattcggcgccgctgacgtgcagttcggcgagcgcggtgacgagcgcgtacggctcggggcggtcggcgcgcagggagggaacggtgacgatgtctgtgccgtcgtcgaagcagccctggacgagggcgctgaggacgccgccgggaccgatctccacgaaggtggtcacgcccagctcgccgagggtctcgatgccgtcggcgaagcgcaccgcctcgcggacgtgccgcacccagtactcgggcgtgtacgcctcggccaaccgaccggtgagattcgcgaccacaggaatccgcggctcactgaacgtcagaccgcgaacgacttccgcgaactcctccagcaccggatccatcaacggcgaatggaacgcgtgactgaccatcaaccgggaggtcttacagccctgttgggtgaagacctcgacgatcgccagcaccgcatcctcggcaccggagaccaccaccgaccgcggcccgttgatcgccgcgatgccgacgccgtgggtgagatgcggcaccacctcgtcctcggccgcctgcaccgccaccatcgccccaccagcgggcagggcctgcatcaacgcggcacgcgccgacaccagcctcgccgcatccccgagcgacaacacacccgccacatgagcagccgcaatctcacccaccgaatgacccgccacataatccggccggacaccccacgactccaacagccgaaacagcgccacctcgacagcgaacaacgccggctgggtgcaaccggtctggttgagctgctccgcgtccgcgtcgagggcgacgtcgaggtgggcgcggatctcgtcgtaggccgcggcgaacaccgggaaggcgtcgtagagttcacgccccatccccaaccgctgcgaaccctgacccgagaacaggaacccggtcttgtcgccgtggcgggccgcgttgcggacgacggcagcggacggggtgccggaggccagtgcccttacgccttcggtgagttcctccaggctctcgccgacgacggccgcccggcggtcccaggcggtgcgcgtcgtggcgagggagaagccgatgtcggccggcgagcggccggggccggtcccgccgctccggccgtcctccaggaaggagagcaggcgctctgcctgggcgcgcagcgccgcgtcgctcttcgccgagagcacccacggcagcgcgccggcggccggggccccggccggctcggcggcgggctcccggtcgagggccggggcctgctcgatgatcgtgtgcgcgttggttccgctgacgccgaaggacgagaccgcggcccggcgggggtggtccgactcgggccatgcgacggcctcggtcagcagcttcacgccgcccgccgaccagtcgacctgagcggtcggctcgtccacgtccagcgtctgcggcaggactccgttgcggatggccatcaccatcttgatcacaccggcgacacccgcggcggcctgcgtgtgaccgatgttggacttgatggatcccagccacaggggccggtcgtccgagtgctcctgtccgtacgtggcgagcagtgcctccgcctcgatcgggtcgccgagggtggtggccgtgccgtgcgcctcgaccgcgtcgacctgggaggcggtcaggcgcgcgttctccaacgcctgccggatcacgcgctcctgcgagggaccgttcggggccgtgagcccgttggaggcgccgtcctggttgacggcgctgccacggatgacggcgagcacctcgtggccgagccgacgggcatcggacaaccgctccagcaggagcacgccgatgccttcggacatgcccgtaccgtcggcggtcgaggagaacgcgcggcagcggccgtcgggcgacaggccgcgctgcgcactgaacgcgatgaaggtgttcggcgtggccatcacggtcacgccgcccgccagggcgagcgagcactcgccgcggcgcagcgcctgggcggccaggtggagcgccaccagcgaggacgagcaggccgtgtcgacggtgaccgccgggccttcgaggccgagggcgtaggagatgcggccggacaccacggcggcggtgttcgcggtgacgaggtgggcctcgctgtcgctgtcgccctgccgctgaaggtaggcgtggtcctggccgttggtgccgacgaacacgccggcccgggtgccgcgtgcggtgacggggtcgatgcccgcgcgttcgagggcctcccaggaggtctgcaggagcagccgctgctgcgggtccatgaccagggcctcgcggggggagatcccgaagaacgcggggtcgaactcgccggcgtcgtagaggaagccgccttcgcgcacgtacgtgcggcccgtccgcccgggctcggggtcgtagatcgtgtccaggtcccagccgcggtcggtggggaacccggacacgccgtcgccgcccgaggcgaccagttgccacagttcctcgggcgaggcgacgccgcccgggtagcggcaggccatcccgacgatggcgatgggctcggtgtccttcgcctccagctcacccagctgcctgcgggtctggctcaggtccaccatcacgcgcttgaggtaatccctgagcttgtcgtcgttcgacatgttttacgtcctcggtagcagtgcgtgagatgagtcagtgggacccgagctcttggtcgatgaggtcgaacatctcgtcgtcggtggcggcgtcgatccggtcgaggtcgaggtcgaagtcgcggtcggtgccgtggccgtcgtcggcggtgttcgccgcggcgtcctgatgggtgtccgtccacttccagagcagcgccttgagccgggcggtgatcttgtcccgtaccgcgtcctgtggggcgagcgcggcgagctgcgcctccagccggtccagttcgccgagcacgggcggggcctcggcggtgaggtcgagcaccaggtccttgtggaggagccgggcgatcgcgacggggttggggtggtcgaagaccagggtgggcttgagccgcagcccggtcgcggccttgagccggttgcgcagttccacggcggtcagggagtcgaacccgatgtcccggaaggccgtggtgggctcgatgcgggcagcggtggcgtggccgagggcggctgccgcctgatggcgcaccaggtccagcatgaccttctcctggtcggcctccggtatcccggcgaggcggcgggccagggcggtggtccctgcggccgctgcctcaccggccgcggcgccggtgtcgccgacgaggccgcggaggacggcgggcagcatgcccgcgcgggccatggcgcgcagtcccggaacgtccagccggaccggcacgatcaccggccggtccacggtcagggcggcgtcgaacagggccagcccctccgccgggctgaacggcaccactccggcccgccccatccggttgcggtcggcgtcggtgatccggtcacccatgccgccgttgtccgtccacaggccccacgcgagcgaggtgccgggcaggcccgcggcccggcgctgccgcgccagcccgtccaggaaggcgttcgcggcggcgtagcccgccgcgccggcgctgcccagaactccggccagggaggagaagagtacgaacgcggagaggttcaggtcccgggtcagctcgtgcaggtgcagcgccccgtcggccttcggccgcagcacggtgtccaggcgccccggggtcagggcggtgatcacgccgtcgtccagggctgccgccgcgtgcacgacggccacgagcgggtgctcggccgggacggaggccagcagttcggcgagggcgtcccggtccgcgatgtcacaggcggccacgtcgacgtgcgcgcccagctcggagagggcggcgacgagttcgccgacgccttcggccgcggggccccgccgactggccagcagcagtctccgtgcgccgcgttcggcaacgaggtgccgcgcgagcgatcgtccgaggccaccggtcgcgccggtgagcagcacggtcccctcggggtcccaggcgtgaccggtgggctcctcgggcggggtgatccgggcgaggcgcggcacgtacagctttccgtcgcgcaccgcggcctgcggctcgtccagagcggcgagcgccgcggccagcgccgggtcgacgccgccgtcagtgaccgtgccgccgttcgtgaccgagtcgtccgcgtcgacgagcaggagccggtccgggtgctcggtctgggccgacttcaccagaccggagaccgcgacgtgcgcgaggtccaaagctgtgccgtccagctcgacggctccgcgcgtcatcaccacgagccgcgcgtcggagaaccgctcgtcggcgacccactcctggacgaccgacagcacaccggccagcgctccgcgcgtcgccgcggcagcatcgccttcactcggggcgcacggcaggaggacgtgggcgggcgtggccgcaccgccgtcgaccgccttgcggagcgcgtcgatatcggagtgaacaccctcgtcgccgaggaccgcccagtcggctacggcagcggtggcgggagcggaggccgcggtgtgctcgacccagtcgatctcgaacatccagtcctggtgcgccacgcgcgaggccagtacctgctgcgcagtcatcgtccgcgtccggacggacgcgacagaggcgacgggagagccgtcggcgtcggacagttcgatcgccaccgcgtcgtcgccgacgggccggatgcggatgcgtacggccccgggccccggagtgtgcacggacatgccgctccaggcgtggggcatgagcacctcgccggggtctgcggcgcggtccgacgtcgccatgccgagggcggcgtccaacaggacggggtgcagggcgtagcggtccgcccggtcccgctccgtgaccggcagttcggcctcggcgtacaactcgtccccggcgcgccaggcggcgcgcagacccggacggccctcgacgtccccgggttcggcacccgtcggcggccagatcatctggtcgaactccggcgccggagcgttccgggtgagctttccggtgacgtggcggacccacggctcgccggagctgcccgccgccggccggctgaagacgcgcaccgagcgccggtcagggtcgtcgtccgcaccgatctgcacctggatgcggacggcgccctgttctgccagaaccagcggggcgtccacgtccagctgttccaggtacgggaacccggcctgccgtcctgcggacagggccagctccacgaacgcggcgaccgggagcaccggcacgccaccgaccgtgtgttccgcgatccagggcaggtcggccggggacagtcggccggtgaacagcacgtcctgcgccccggcggtctccaccaccgcgccgagcagggcgtggccggaggagtccaggcccgccgaggagacgtcgaccgcggtcgtgcctttgagccagtagcgctcgcgctggaaggcgtacgtgggcaggtcgacacgcagggcgccgggaaacagcgcctgccagtccggggagacgccacgcgtgtgcaactgcccgacggcgagcgtgagcgcctggggttcggggcggtcggtacgcagagcgggaacggtgacgatgtccgcgtcgtcgaggcagccctgggcgagggcgctcaggacaccgcccgggccgacctccacgaacgtggtcacgcccagctcgtgcagggtccgcacgccatcggcgaaacggaccgcctcacggacgtgccggacccagtgctcgggggtgtacggctcggccaggcggcccgtgaggttggagaccacaggaatccgcggctcaccgaacgtcagaccgcggacaaccgccgcgaactcctccaacatcggatccatcaacggcgaatggaacgcgtgactgaccttcaaccgggaggtcttacggccctgagcagcaaacacctcggcaaccgccatgaccgcgtcctcggcgccggagaccacgaccgactgagggccgttgatcgccgcgatgccgacctcgccggtcaggtacggcagcacctcgtcctcggccgcctgcaccgccaccatcgcgccgccggcgggcaacgcctgcatcaacgcggcacgcaccgacaccagcctcgccgcatccccgagcgacaacaccccggccacgtgcgcggcagcaatctctcccacggagtgaccggccacgtaatccggccggatggcccacgactccagcaaccggaacagcgccacctccatcgcgaacaacgccggctgcgtcgaacccgtctgatgaagcgtttccgcatcgacatcgaccggcaagtccaacagcgcgcacacctcgttgtaggccgcggcgaacacggggtacgcctcgtacaactcgcgccccatgccgatccgctgcgaaccctgacccgagaacaggaacccgaccttgccccggtcggccccggcgcgccccgtcaccacctgtgccgcgggctcgcccgccgcgagggcggtcaggatcgcgcgcagctcttccccgtcggcgccgacgaccgccgcccggtgctccagcgccgagcgggtggccgccagcgagaacccgacgtcggccggtgacgcggccgcgaggtccacggacgacagcagtcgttgtgcctgctctcgcagcgccgccccattcttcgcggagagtacccacggcaccaccgtggtccgggcccgcagcagttcctcggccacgccctcgccttcagccgtgtcatcggccgggtcccccgcctccggttcgggcgcctgctcgaggatgatgtgcgcattggtgccgctgatcccgaacgacgagaccccggcccggcgagggtggtccgtctccggccacgcgatcgcctccgtcagcaggtcgaccgagccgaccgaccagtcgacccgcggggtcggccggtccacgtggagggtcttcggcagcacgccgtgctgcatcgccagcaccatcttgatcacaccggcgacacccgccgcggcctgcgtgtgaccgatgttggacttcagcgagccgagcagcagcggccgttcgcgctcttgtccataggtcgccagcagcgcctgcgcctcgatcgggtcgccgaggctggtgcccgtgccgtgtgcttcgacggcgtcgacctcctcggcggacagccgggcgccggccagcgcttcgaggatcacgcgctgctgcgaggggccgttcggcgcggtcaggccgttggacgcgccgtcctggttgacggcgctgccccggacgaccgcgagcaccttgtggccgagtcggcgggcgtcccgcagccgctccacgagcagcaggccggtgccttcggaccaggacgcgccgtccgccgccgccgcgaaggacttgcagcggccgtcgggggcgagtccgcgctggcggctgaactcgacgaaggcgctcgggcccgccatgaccgtcacgccgccggcgagcgccatggagcactcgccggtgcgtagcgcctgcacggcgaggtgcagggcgacgagcgaggacgagcaggcggtgtcgacggtgaccgcggggccctcgaagccgaaggtgtaggcgatgcgcccggaggcgacgctgccggagttgccggtgctcatcagcccctcgaccccttcggggaggacgccgggcgtgaagccgtagtcgtggtacatcagaccggcgaagacgccggtgcggctgcccttgaggccggcggggtcgatgcccgcgtgctcgaaggcctcccacgcggcctccagcagcagccgctgctgcgggtccatggccagcgcctcgcgcggcgaaatcccgaagaattcggcgtcgaagtccgccgcgtcgtgcaggaagccgccctgccgggtgtagaccttgccgggctgctcggggtcggggtcgtagagcgcgtcgacgtcccagccgcggtccacggggaactgcgagatggcgtcttcgccctcggccagcagccgccacagctcctcgggggagccgacgccgccggggaaccggcagctcatacccacaatggcgatcggctcctgggcgcgggcctccagctcgcgcacgcgccgccgggcctggcgcaggtcggtggtggtccgcttgaggtagtcccggagcttgtcttcgttcatcatcggtgtcgcccgcccccttttggctgcgcagttcaggagatgccgagttcgtcgtcgaggagctcgtacagctcctcgtcgctcgccgagctgaggtcgtcttcgtcctcggctccgccggcgcctcccggatcggccggctcgttcccgttccagcgggcgagcagtgcctggagacgcatgttgatcttggttcgggtgatgttgtcgatgccgtccgctccggcaccgtcgagggcggcaccgaggcggtcgagctcgtcgaagaccggcgccgtcccggccgtaccaccggggaggtctttcagcacccgctgcgcgagcaccgcgggcgtcgggtggtcgaagaccagcgtcgcgggcagccgcaggcccgtggcctggttcatccggttgcggagctccaccgcggtcagcgagtcgaagcccaggtcgccgaaggcctggtcgggctggacggtcttggccgagctgtgtccgaggacggcggcgacctcggaccggacgaggtccagcacggcctcttcgcgctcgctctcgggcaggcccgcgatccgctgcgccagcggtaccgcggccgcccggtccgtgcgccgcagccggccgccgacgagcgccctgagcagcggcggcaccggggcggtcgcgttccgcagggcggcgaggtccaaccgtgccgccaccaccaggggctcctgcagcgcgagcgcggcgtcgaggagttccaggccgtcctcgtcggacagcggcagcacgccgccgcgggcgagccgggtccggtcggcgccgccgaggtcctcggtcatggtgccggtgcgctgccacaggccccatggcaacgacaccgcgggcagaccctgggcccggcggcgccgggcgaaggcgtccaggaaggcgttggccgcggcgtagttggcctggccgggggtgccgagcgtgcccgcgagcgaggagaagaggacgaacgccgacacgtcaccggccagctcgtgcaggttcaacaccgcgtcgaccttggggcgcagcaccatctccatgcgctccggcgtaagcgaaccgatcacgccgtcgtcgaggacgccggccgtgtgcaccacggccgtcaccggcgtgccggacagcacctcggcgagagcgtcccggtcggccacgtcgcaggcggcccagagcacttcggcacccgcggcggtcagttcctcctggagctccgccgcaccctcggcgtccgcgccgcgccggctcatcaacagcaggctgcgcaacccgtgttcggcgaccaggtgccgggcgacgagtccgcccagggcaccggacgcgccggtcaggagcaccctgccggtcccgaagtccggggtggcccgcggggcgtcggcggcggccctggcgagccggggcagcaggagcgcgtcgccgcgcagtgccgcctgcggctcctcggaggcgacgagccgggggacgaccgtcgccgcgacctgctccacgtcggcgttctgttcggtgtcgaggaggacgatgcggtccgggttctccgactgtgccgaccggaccaggccccacacggccgcctgcaccgggtcgccctgtgccgactcgtcgcctgcggcgaccgcgccccgggtcaccagcaccaggcgggcggcccggtcctcggcctgccaccactggaccagccagagcacttcggcgaggacgctccggacccgctcgacatcggtacccgacccgccggggcaggggacgacgacggcgtccgtgtccgcctgcgccccggtctccaccgtgggggcggcgaggagggcggcgatgccgtcgtaggcctgtacgactggtgtccgcgcgtcagcggtggcggcgagcggtgcccactgcacggtgaaaagggagtcccgggagctcgggcgcagttgctcgaccgacaccgggcgcagcgtcagcgactccaccgacacgacgggacgacccgtgccgtcggcggcctccagccgtaccgcatccccgccgacctgggagagccgtacccgcaggccggccgctccggttccgtgcaccgtgacgcgggaccacgcgaagggcagcaggggcccgtcggcagccggtacgaggccgcccgcgcccagcgcgtgcagcgcggagtcgagcagggccgggtgcacaccgaacgcgtccgtctgcgccaggtcggggacggcgagttcggcgtagaccgcgtcgtggccgcgccaggcggcacgcagcccctgaaagagcgggccgtagctcaggccgaggtccgccatgcggtcgtagaagccgtccaggtccaccggccgggcgtcggccgggggccagttgctcaggtcggtgccggagggggctccgccggcggcgaggacgccggtggcgttgcggatccacgggccgtcgtccccggctcgcgagtgcacgctcaacgggcggcggccggagtcgtcctgcgcgcccacgagcacctggagcgcgacaccgccgtgctcgggcagcaccagcggtgcctgcagggtgagctcctcgaccaggtcgcagccggtctcggccgcggcgtgggcagccagttccacgaaggccgtgcccggcagcagcaccgtgcccagcaccgcgtggtcggccagccagggctgggcttgcagggacagcagcccggtgagcaggtggccgccggcgtccggcaactccaccgccgcgcccaggaacgggtggtcggcggcgtccagcccggccgctcgtacgtcaccggccggagcgccggcctccagccagtaccgctcgtgctgaaacgcgtaggtcgggaggtcgacgcggcgcgcgcccggcaggacggcgtcccagtcgatggcgacgccgtgcacaagggcctgggccagggccagcatcagccggttccgtccgccgtcgcggcggcgcagcgtcggtacgaccgcggcgtccgcgtcggcggcctcgatggcatcctggatgcccgccaactggacggggtgcgggctgacttcgacgaacacgtcgtgcccgtcggccagagcggcccggatcgcgtcgtggaaccgcaccgtctgccgcatgttgcggtaccagtagccggagcccagctcgtccgcggccagcttcccgcccgtcaccgtggagtagaagggcacggagccggggagcgggctgatgccggcgaacccctcgctcgcctgcgcttcgacgcgttcgatctgcggcgagtgcgcggcgtagtcgacggcgaccctgcgggcctggatggcatcctgttggcagtgagcgaggaattcgtcgagggcgtcggtgtccccggagaccacaacggtggcgggcccgttcacggcggcgatgccgaggcggccggtccaccggccgaccagttcccgcgccttctcgtccgggagcgtcaccgaggccatggcgccgcggccctggagttcgcggaccgcaaggctgcgccgcaccacgacgcgtgctccgtcctccagggagatcgctccggcgatcaccgccgcggagacctcgccctgggagtgccccacgaccgcgtcgggggtcactccgaaggagcgccacacctcggcgagggcgaccgtcatcgcccacagcacgggctgcagcacgtcgacccggtcctgctcgacctcggacgtgccgcgcagcaccgcggtcagcgaccagtccacgtgcggcgcgagggcgcgctcgcaggcgtcgatccggtcgcggaagaccggtgaggtctcgagcagtttggcggccatgcccacccactgcgacccctgcccggggaagacgaagacggtcttgccgccggtgtgtgcggtgccggtcaccacgccgggcggcgtggcaccgccggcgacaccggccagcccctgccggagctcctgaagggtctgcccgaccaccacggcgcggtgttcgaaggccgccctggtcgtggccagcgagtacgccacgtcggccgcgaaggccgcctcgccgacgtcgtccctgtcgttgtcgccgtcgtggtcgtccaggaaggacacgaggccggcggcctgcgcctgcagcgcggcttcggtcctgccggagagcacccagggaacggccgcgccggaatcggacgtcaggggcagttcctcggtcgtgggggcctgttcgatgatggtgtgggcgttggtgccgctgacgccgaaggacgacacggcagcacggcgcgggcggtccgaatcgggccatgcgacggcctccgtcagcagccggacgtcaccggccgaccagtccacgtgcggtgtgggttcgtcgacgtgcaaggtctgcgggagcactccgtggcgcatggccatgaccatcttgatcacacctgcgacacccgcggcggcctgcgtgtggccgatgttggacttcagcgagcccagccacagcggctgtcctgcgggccgctcctggccgtacgtggcgagcagcgcctgcgcctcgatcgggtcgccaagcgtcgtgcccgtaccgtgcgcctccaccgcgtccacatcggctggcttgagcccggcggacgccagcgcctgccggatcacccgctgctgcgccggaccgttcggcgcggtcagaccgttggacgcaccgtcctggttcaccgcactgccccgcacgaccgccagcacacggtgaccgttgcgctccgcgtccgacagccgctccaccaacaacaggcccactccctcgccccagcccgtaccgtccgcaccggcagcgaacgccttgcaccgaccgtcgggcgacaacccgcgctgccgactgaactccacgaaaaccgtcgggccggccatgaccgtgacgccgccggccagcgccatcgtgcactcgccgttgcgcagcgactggacggccaggtgcagggcgacgagcgacgaggagcaggccgtgtcgatcgtgacggccgggccctccaggccgaaggtgtaggacacgcgcccggaggcgacgctgccggagcctccggtggtgagcagtccctcgacgccctcgggcagttggcgcgggccctggccgtagtcgtggtacatcaggccggtgaagacgccggtacggctgccccggatggtcgccgggtcgatcccggcgcgttcgaacgcctcccaggacgcctccagcagcaaccgctgctgcgggtccatcgccagggcctcgcgggggctgatgccgaagaagccggcgtcgaactcggccgcctcgtgcaggaagccgccgtcgcgcgcgtacgtcttgccgaggcgctcggggtcggggtcgtagagcccgtcgacgtcccagccgcggttgtccgggaaccgggtgatgccgtcccggccggaggccaccagccgccacaggtcctccggcgagcggaccccgcccgggaggcgacaactcatgccgacgatggcgatcggctcgtcggcggcggtcgcggtctgccgcgccgcggccctggccgtgaccgcgggggcctcgccgaggagttcggtgccgatgtgccgggcgagggcggcgggggtggggtggtcgaagacgagggtggcgggcaggcgcaggccggtggccgtggcgagccggttgcgcagctccacggccgtcagcgagtcgaagccgaggtcctggaaggcgtacgtgggctggacggcccgggacgaggagtgaccgagcacggcggcgacctcgccccggaccagttccaggagggcctcgtcgcgctcgtcggcggccagaccggcgaggcgttcggccagggatccggcggcggcgcgctgggccgtgccgcgtagggagacgcggacgagtccacgcagcagggccggtacggtttctgccgcccggttgcgcaaggcggcggtgtcgaggcggacgggcacgagtacgggctcgttggaggcgagcgccgcgtcgaacagccgcaggccgtcctcggtgggcagcggcaggacgccggaacgcgccatccgcgacctgcccgcctcgtcgagggcgtcggccatggcgccctcctgctcccacaggccccacgccagcgagaccgtgggccgtccctgggcgtggcggtgccgggcgaaggcgtcgaggaaggcgttggccgcggcgtagttgccctggccggggttgccgaagacgcccgctgcggaggagaacagcacgaacgtcgtgctcgggccggtgagctcgtccaggttgagcacggcgtcggccttgggcgcgaggaccgcgcccacgcgctccggggtcagcgcggcgatcacgccgtcgtcgagcacgccggcggtgtgcacaaccgagtcgaccggggtggcggccagcagccgggcgagggcgtcccgttcggcgaggtcgcaggcggcccacgtcgcttcggcgccgagcgccgcgagttcggccttcaggtcggctgcacccggggcgtccgcgccacggcggctgacgagcagcagccggcgcacgccgtgtccggtcaccaggtgacgagcgagggttttgcccagcgcgccagcggcgccggtgagcagcacggtgccgaggcgggaggcagcgccctcgacgagggccgaggcagcttcgtccgcgcggccggtgaccgcgtcctccgttgccagggaggcggcgcgggccaggcgcggtgcgctgacctccccttcgcggacgacgacgtggggttcgccggacagcacgacgccgggcacgagcgcggccgcctcgtccgggcggtcggtttcgagcagcacgatccggccggggttctccgcctgggccgagcggaccagtccgcccgcggcggcgtgcgcgaggtcgtcacagcgcgccatcagcacgaggcgcggcgtccggtcctcggcgaaccagcgctgaaccagccgcagcacgtcggtgctgaccgcacggacccgctcggcctcggtcgccccttccgggccgtcggggcacgggaccacgaccacgtccggctgcgacggcccgtcggcctcagccagagcggcgaggtccgggacgtacgccaccgccgtcccgtccgcgtcgtcggagggcagggtcagcggcgcccgctcgacggtgaacatcgcgtcaccggagcgcttgcgcagccgctcggccgacaccgcgcgcagtgtcagcgactcgacggacgccaccggctcgcccgcgccgtcggccaccagcagggacaccgcgtccgtaccggccggtgccagcctgacccgtagggtggacgcgcccgtggcgcgcacggacacgcgggaccaggcgaacggcaggagcggcccgtccgcctcggcaacgagggagccgtccgcaccgcccgcgccgatcgcgtgcagtgccgcgtcgagcagagccgggtgcaggaggaaggaaccggtgtccgtgccgtcggggagggcgacttccgcgaagacgtcctcgcccgtgcgccaggcgctccgcagtccacggaacgccggtccgtaggccaggccgagggcggccagccggtcgtagaagccgtcgaggtcgaccggctcggagcccgtcggcggccacgccgtgagcgtccggtcggcggccgcggcgccggcctcttcgctcccttcggtgacgaagccggtcgcgtggcggacccacggcaggtcggagtcgtcctcggggcgcgagtgcacggtcagcggcctgcggccggtgccgtcgaccgcgccgacccacacctgaaccgcgacgccgccctgctcgggcaccaccaggggcgcttcgagggtgaggtcctccagtaatgcgcagccggcttcgtcggcggcgcgcacggccagttcgacgaacgcggtgcccggcagcagcgcggttccgagcacggcgtggtcgctcagccacgggtgcgtgcgcagggacagccggccggtcagcagccgctcgtcgccgccggccagggatacggcggcgcccagcagcgggtggtcggccgagccaaggccggcggcgcggacgccaccgggagcggctggtgaggcgtcgagccagtagcgctcgtactggaaggcgtaggtgggcaggtcgacgcggcgggcgccggggaagaaggcgtgccagtccggggagacgccgtgcgcgtgcagttcggagacggcggcgacgagtgcgacccgctcgggacggtcggcgcgcagggcgggcacggtgaccacgtcgtcgtccaggcagccctcggcgagggcgctcagcacgccccccggaccgatctcgacgaacgtggtcacacccaggtcgttcagagtccggacgccgtccgcgaagcggaccgcttcgcggacgtgccggacccagtactggggggtgtagggctcggccaggcggccggtgaggttggagaccaccgggatctgcggccggtggaacgtcagactgcggacgacctccgcgaactcctccaggatggggtccatcagcggcgagtggaacgcgtggctgaccttcagccgggaggacttgcggccctgctgccggaaggcctccgcgatcgcggtgaccgcgtcctcggctccggacaccacgacggaccgcggcccgttgatcgccgcgatgccgacggcgtcggtgaggtgcggcagcacctcgtcctcggtcgcctggacagcgaccatcgccccgccggcgggcagggcctgcatgaggcgggcgcgggcggacaccagcttcgcggcgtcgtcgagcgacagcaccccggccacatgtgcggcggccagctctccgacggagtgaccggccacatagtccgcccggatcccccacgattccaggagccggaacagcgccacctcgaccgcgaaaagtgcgggctgggcggcaccggtgcggtgcagttcttccgagtcgacgtcgaccacggcgtccagctgcgcgcagacctcgtcgtacgcggcggcgaacgccgggtaggacgcgtacaactcacgccccatgcccaggcgttgcgaaccctgaccggagaagaggaagccgacgcgaccaccggtgccggagagaccgcgcgcgacgccccgggccggggagccggaggccacggcccgcagcccctcggcgagttccgccggcgtctcaccctggagcaccgcgcggtgctccagggccgtgcgcgtcgtggcgagcgagaacgccacgtcgagcggggggacttcggcgtccgtgcgggacagcaggcgttcggcctgtgcgcgcagggcctcctcggtcctgccggagatcacccacggcaccggtccgcccgcggccgggcgcgccgcctccgaggcgacgggctcggcgctctccgcgccttcctccggcccttccggggccccggtgtcctgtgcgaacgcttcggccgacggggcttcctcgatgatcgtgtgcgcgttggtgccgctgatcccgaaggaggagataccggcccggcgcggctggtccgacgccgaccagggcgtgcgctcggtgagcagccgtacggcacccgccgtccagtcgacgtgcacggacggcgcgtcgacgtgcagcgtgcgcggcagttcgccgtggcgcatggccatgaccatcttgatgatgcccgccacgccggctgcggcctgggtgtggccgatgttggacttgatcgagcccagccacagcggcttgtcgtcgggacggccctgcccgtacgtcgcgagcagcgcctgcgcctcgatcgggtcgcccagccgggtgcccgtgccgtgcgcctccaccgcgtcgacctgtgcggtggtcagctgggcggcggccagggcctggcggatcacccgctgctgggaggggccgttgggggcggtcaggccgttggacgcgccgtcctggttgacggcggagccccggacgaccgcaaggacctcgtgcccgttgcggcgggcgtccgagaggcgctccacgagcagcaggccggcgccctcgccccagccggtgccgtcggcaccggccgcgaacggcttgcagcggccgtcgggtgccagtccgcgctggcggctgaagccgacgaaggtggcggggccgaccatcgcggtgacaccgcccgccacggccagcgagcactcgccgttgcgcagcgactggacggccaggtgcagggccaccagggacgacgagcaggccgtgtcgaccgtgacggccgggccttcgaggccgaaggtgtaggccacgcggccggaggcgacgctgcccgaggtgcccgtccccaggtaaccctccaggtcctgcggggagttctggagggcggcgaggaactcgtggttcatcacgccggcgaacacgccggtcctgctccccgccagcgaggcggcatcgattccggcccgctcgaagagctcccacgacgtctccagcagcagccgttgctgggggtccatcgcgagcgcctcgcggggcgagatcccgaagaggccggcgtcgaaccgcgcgaggtcgcgcaggaacgcgccctcgcgggcgtagctggtcccgcgggactccgggtccgggtcgtagagggcgtccaggtcccagccgcggtcggcggggaactccgagacggcgtcgcggccgcctgcgaccaactcccacagatcctcgggcgagtcgacccctcccgggtagcggcagctcatcccgatgatggccaccggctccccggcggcgtcctcgtagtcacgaaggcgccgccgggtctcctggagatctgcggtgactcgcttcaggaaatggcggagcttgtcctcgttcgccaccgaaatcgtccctcacccctgtgaagacttatgggaattcggcaagaggtcaccgggacgcgccggagcggtcaggaaatcccgaattccttgccgagcagatcgaatacttcgtcgtccgtggccgattccagatcgctgccgcccgtaccagggccttcctgggccggcgccttgccgaattcaccggcaatcgccaacaaaccctggagctttgacaggatccggtcgcgagcttcactcgctgccaacgtcgtgaccaattcttgttcgaccctgtccagatcggcaagtagggaatccactagggccggttcggccgcccccgccgccgccatgaacacatgacgggccaggagagcgggtgtcggatggtcgaagaccagcgtcgcggggagccgcagcccggtggccttgttcagccggttgcgcagttcgacggccgtaagggagtcgaagcccaggtcctggaaggcgtgttccggccggaccgtacgatccgacgcgtgccccaggcccgcggccacctcggcccggaccaggtccagcacggtcttctcccgctcggcctcaggcatctcctccaggcgctcggccagcgaggacgcggagggagcggcggcggcccgcgcggtcctccgggcggccgcggccggcacgagggcgcgcagcaccggcggtgcctcaccggcacgcagcgcgccggtgtcgatgcggaccggggcgagtaccgcctcgtccgaagccagtgccgcgtcgaacagccgcagcccctcctcgggcggcagcggcagcacgccgctgcgcgccatccgcgcccggtcggcctcgacgaggccgtccgtcatcgcaccggactgttcccacacaccccatgccagcgatatcgcgggcagcccctcacggcgccggtgcgccgagaaggcgtcaaggaaggaattcgccgcggcgtagctcgcctgaccggcgctgccgaccatgccggcgacggacgagaacaccacaaaggcggccaggcccatgtcccgggtgcactcgtgcaggttcagcacggcgtccaccttggggcggaagacctccctcatcctctccggtgtgagcgaggcgacgatcccgtcgccgagaacacccgcggtgtgcacgacggccgacagcgattgctccccgagcccgttcagcattccggagacggcctccctgtccgcgacgtcgcaggccgcccagcgcacctcggcgccccacgcggccagttcggcctccagctcgaccgcgccaggggcctccgcgccgcgccggctgagcagcagcaggctgcgtacgccgtgctcggcgaccaggtgccgggcgacgagcccgcccagcgcaccggacgcaccggtcagcaggacggggccgacgccgaagtccggcgtgccggtggcggtccccgtggcgctccgggtggccttcaccaggcgcggtacgaacacctccccgtcgcggaccgcgaactgcggctcaccggaagcgagcgcggcaggcagcacacggaccgcctcatcggtctcctcggcctccaccagcacgatccggtccgggttctccgactgagcagaccgcacgagcccccacaccgcagcatgagccagatcgcccggacgcgtcaccaacgccagacgccccgcacgctcctccgccaaccaccactgcaccagcgccagaacctcactcgtggtgctgtgcacgcggtcggcggtctccctaccggaacccgccgggcacggaacgacagtgaccaccgcgacatcgggaagggccggctcggtcgacagcgcggccaggtccgcgtagctccgtacgtcgaggccggcggcggcgtcagtctccgtgaggaccgcgggctgccatgcgaggccgaacagcgagtcgtcggcacgcctgccggagccgcccgccgcgagcagttgctcgcgcgacaccggccgcagcgacagtgagccgaccgtggccaccagaccacccgaggcgtcggccacggtcagcgacaccgcgtccgtacccgtgcgagagagcttgacccgcagcgccgtcgcccccgcggcccgcacacccacttcggaccaggcgaagggcagcagcggcccgtcgaggacggggacgagcccgcccgcgccgactgcgtggagcgccgcgtccagcagcgccggatgcacggcgaacgcgcccgcctccgtgccctcggggagggcgacctccgcgaggacgtcgtccccgctgcgccacaccgaccgcaggccgcggaagaccgggccgtagcccaggccgagtccgtccaggccctcgtagaacccggtcaggtcgacggcctccgcacccgccggcggccacgcgccgaggtccgcgccgtgcggcggctcgggcagcgcgtccgtcaggcggccgaccgcgtgccgcacccacggcgcgtcgtccggggcgtcctcacgtcgcgagtgcacgctcagcgcgcacctgcccggctcctcctcggcctcgacccacacctgcacggccacaccaccgcgctccgggacgatcagcggtgcttccagcgtcaggtcctcgacctgtgcacaaccggcctcctcgcccgcgcgcaccgccagttccacgagcgcggtacccggcagcagcacgctgtccatgaccgtgtggtcggcgagccagggatgcgtcctgagtgagagccgccctgtgaccaggaacccgccggcgccggggagcgcgaccgccgcaccggccaacgggtgctccgccgcccccagtccgagcccggtggcagccgctgtgccggtgtactcctcgggcgcttccagccagaggcgctcgtactggaaggggtaggtcggcaggtcgacgcgccgggcgcccggaaagagcgcccgccagtcgggggagacgccatgggcgtgcagctcggcgagcgcggtgacgacggcctgcggctcggggcggtcggtccgtacggcggggacggtgacgatgtcgccgtcgaggcagccctgggcgagggcgctgaggacgccgccggggccgatctcgacgaacgtggtcacgcccagctcgtgcagggtgtgcaggccgtcggcgaagcggaccgcctcgcggacgtgccggacccagtactcgggggtgtacggctcggccagccggccggtgaggttcgacacgacgggaagccgcggctcgttgaaggacagaccgctgacggcctcggcgaactcctccagcatcggatccatcagcggcgagtggaaggcgtgactgaccttcaaccgggacgtcttacggccccgctcccggaaggcctcgccgatggcgacgaccacgtcctcggcaccggagaccacgacggactgcgggccgttgaccgccgcgataccgacgccgtcggtgagatgtggcagcacctcgtcctcggtcgcctggacggcgaccatcgccccgtcggcgggcagggcctgcatcagtgcggcacgcgccgacaccagcttcgccgcgtcctcgagcgacagcacccccgccacgtgcgcggccgcgatctcaccgaccgagtgaccggccacgtagtccggccggatgccccacgattcgagaagccggaacagggcgacctcgacggcgaagagcgcgggctgcgtcgtacccgtctggttgagctcctcggagtcgacgtcgacgggcgcgtccacaagcgcgcacacctcgtcgtacgccgcagcgaacaccgggaaagcatcgtagagttcgcgccccatgccgatcctctgcgagccctgacccgagaacaagaaccctgacttgccgccggcgcccggttcacccaggacgacccgcgtggacggggaccccgcggccagcgcgcggagcccttccaggagttcgtcccggctctcccccaccacggcggcccgatgctccatggccgagcgtgtggtggcgagcgagaagccgatgtcggccggcggcaggtccatctccgggaccagggacagcaggcgctccgcctgtgcccgcagcgccgcctccgtcctgcccgacagcacccacggcacggccttgccggagtcgggcacgggcggcagctccgcggtgtcgggagcctgttcgacgatcacgtgggcgttggtgccgctgatgccgaaggatgacacggcggcccggcgcgggtgatcggtctccggccactccatggcctcggtcagcagccggacatcaccggccgaccagtccacgtgcggcgtcggctcgtcgacgtgcagggtccgcggcagcgcaccgtgccgcatcgccatgaccatcttgatcacaccaccgacaccggccgcggcctgggcgtggccgatgttcgacttcagggagcccagccacaacggccggtccccaggccgctcctgaccatatgtagcgatcagcgcctgcgcctcgatcgggtcacccagcttcgtccccgtaccgtgcgcctccaccgcgtcgacctgctccgaggacacaccggcgttggccagcgcctgccggatcacccgctgctgcgagggcccgttcggggccgtcagaccgttcgacgcgccgtcctggttcaccgccgtgccgcggaccaccgccagcaccgtgtgcccgttgcgccgggcgtcggacagccgctccaccagcagcatgcccgcgccctcggcccaacccgtaccatccgcgccggccgcgaacgccttgcaccggccgtccgccgacaagccgcgctgacggctgaactccacgaacgtcgagggagtcgccatgacggtgacaccgccgaccagcgccatcgagcactcgccactgcgcagcgcctgggtcgccaggtgcagcgccaccagcgacgacgagcacgccgtgtcgaccgtgaccgccgggccctcgagcccgaacgtgtacgagacccggccggaggcgatgctgcccgcgctgccactgcccaggtaggcgtccatgccctccggagccgttttcacgcgcccgccgtagtcgtggtacatcacgccggcgaagacaccggtcctgctgccccgcaccgtcgccgggtcgatcccggcccgctcgaacgcctcccacgacgtctccaacagcaaccgctgctgcgggtccatcgccaacgcctcacgcggcgagatcccgaagaaggccgggtcgaactcggcagcctcgtggaggaagccgccgtggcgcacgtaggacttgccggagcggtcggggtccgggtcgtagaggttctcgacgtcccagccgcggtcctcggggaagcccgagatcgcgtcgccgccggatgcgacgaggcgccacaggtcttcgggtgaccgcacgtcaccggggaaccggcaggccatgcccacgatcgcgatcgcctcgtccgtcccggtcaccgcggcgatcgcggcctcggcctgctcctggacgcccagcgtctcggccagcaggaagcgggagagcgcgacaggcgtgggatggtcgaagaccatggtcacggggagccgcagcccggtcgccgcgttcagccggttgcggagttccaccgaggtgagcgagtcgaaaccggcgtcctggaacgcgtgttccggctggacggcctgggccgaggcgtggccgagtacggcggcgacctcggcgcgcaccaggtccagcaccacctgctcgcgctcggcctgcggcagcccggccagccgctgacccagcgatcccttcggcgcggtctgcgccatgcgtcgcgcggtgccccgtacggtaccgcgcagccctcgcaggaccggcggcaccgtgccctgcagcccgcccaggtccagccgcagcggggcgacgacggcccgatccagggccagtgccgcgtcgaacagccgcagtccttcgtcgacggctatcggggccaggcccacccgcttgagccgggcgaggtccgcctggtcgagccggtcggccatgccgctgccctgctcccacaggccccacgccagcgacgtggcggggagcccccgggcgcgccgggcttcggcgaaggcgtcgaggaaggcgttcgccgccgcgtaattgccctgtcccgcgctgcccaggattccggacaccgaggagaagacgacgaacgccgacaggtcgctcgtcagttcatggaggttgagcacggcgtccgtcttcgggcgcagcaccttctccatgcgctccggggtgagcgcggcgatcacgccgtcgtcgaggacgccggccgcgtgcaccacggccgtcaccggcgtgccggccagcacctcggcgagagcgtcccggtcggccgcgtcgcaagccgcccagcgcacctcggcgccccacgcggccagttcggcctccagctcgaccgcgccaggggcctccgcgccgcgccggctgagcagcagcaggctgcgtacgccgtgctcggcgaccaggtgccgggcgacgagcccgcccagcgcaccggacgcaccggtcagcaggacggggccgacgccgaagtccggcgtgccggtggcggtccccgtggcgctccgggtggccttcaccaggcgcggtacgaacacctccccgtcgcggaccgcgaactgcggctcaccggaagcgagcgcggcaggcagcacacggaccgcctcatcggtctcctcggcctccaccagcacgatccggtccgggttctccgactgagcagaccgcacgagcccccacaccgcagcatgagccagatcgcccggacgcgtcaccaacgccagacgccccgcacgctcctccgccaaccaccactgcaccagcgccagaacctcactcgtggtgctgtgcacgcggtcggcggtctccctaccggaacccgccgggcacggaacgaccacgacgtccggtgtcccttccgactcccgcagtgcgtcgaagtccgcgacggtctcgatcatcagcgcgtcggtggcggagggcagagtgaaccgcgtccactccagcccgaacagctgatcgccgccaacagcaccgggcaattgctccgccgaagcggcccgcaacgacagcgactcgaccgaggccaccgggtcaccggcgccatcggccacggccagcgtcaccgaaccggtggccgtccgcgacagcttcacccgcaccatcgccgcaccggccgcctgcacgacgacgccggaccacgcgaacggcagggccgggctgtcgtccagcgacaccagcccaccggcggccagtgcgtgcagggcggcgtccagcagcgccgggtgcagggcgaacgccgccgcctcggcagccgactcgtccggcagctcgacctcggcgaagacgtcgtccccgtcgcgccacaccgagcgcaggccctggaagaccggaccgtagtccaggcccgcagcagccatgccttcgtagaacgccgtcaggtcgacggcctccgcacccgccggtggccacgcgccgagcttcgcggcggacggtgcctctgccgaggacagcacacccgtcgcgtgccgcagccacgaacggtcgtcgacgcgcgagtgcacgctcagctgccgccggcctgactcgtcctccgggccgacagccacctgaagggtgacgccaccgcgctcgggcacgaccaggggaagctcaagggtgaggtcttcgatccatccgcatcccgtctcgtcgcccgcccggatcgccagctcgacgaacgcggtgccgggcagcagaacaatcccgttcacggcgtggtcggcaagccaagggtgggttccgagggagagcagcccagtgagcacggccccgtcgctgtcggccgtcgcaatcgcggcaccgagcagcggatggtccgcagcccccagaccggcggcccggacgtcaccggacgcctgaggcgcatcgagccagtagcgctcgcgctggaaggcgtacgtgggcaggtcgacgcggcgggcgcccgggaagagcgcctgccattcgggcgagatgccgtgggtgtgcagttgccccacggcggtgacgagggcgtacggctcggggcggtcggcgcgcagggcgggaacggtgacgatgtgtgtgccgtcgtcgaggcagccctgtacgagggcgctgaggacaccacccgggccgatctcgacgaacatggtcacgcccagctcgtgcagggtgtgcaggccgtcggcgaagcggaccgcctcgcggacgtgccggacccagtactcggggatgtacacctcggccaaccggccggtgagattcgagaccaccgggatccgcggctcactgaacgtcagaccgcggacgacctcggcgaactcctccagcatcgggtccatcagcggcgagtggaaggcgtgactgaccttcaaccgggacgtcttgcggccctgctgcgcgaagacctcggcgatgtcgagaacggcatcctcggagccagaaagcacgacggaccgaggcccgttgatcgccgcgaggccgacgccgtgggtgaggtgcggcagcacttccgcctcggtggcctggatcgcgaccatcgcaccacccgcgggcagggcctgcatcagcgcggcacgcgccgacaccagcttcgccgcgtcctcgagcgacagcaccccggccacgtgcgcggccgcgatctcaccgaccgagtgaccggccacgtagtccggccggatgccccacgattcgagaagccggaacagggcgacctcgacagcgaacaacgccggctgcgtcgaacccgtctgatgaagagtttccgcatcaacgtcgaccgtggcgtccaaaagcgcgcacacctcgtcgtacgccgcagcgaagacggggtacgccgcgtacagctcacgccccatgccgatccgctgcgaaccctgacccgagaacaagaacccgaccctgcccccgacggcaccgcccaccggagcagcgccggaaacaatcccctccagcccctggcggaactccccaagctcctcccccacgaccgccgcacggcactccagcaccgcacgcgacgtcgccagcgagtacgccacgtcctccggccgaaccccggcacccccgacgccctcagcgtccaggaaggacaacaaccggcccgcctgctcccgcagcgccgcatcgctcttcgccgacagcacccacgggaccggtcctgcaacggccgtcccacgggcggtcacttcgctcgtcgcggcctgctcgacgatgacgtgcgcgttggtgccgctcacaccgaaggaggacaccgcggcccggcgcggcccgtcgctcgcaggccactccacggcctcggtcagcagctgcaccgcgcccgccgaccagtccacgtgcggggtcggctcgtccacatgcagggtctgcggcagcacgccgtgctgcatcgccatgaccatcttgatcacaccaccgacacccgcagccgcctgcgaatgcccgatgttcgacttcagcgaacccagccacaacggccggtcctccgaccgctcctgcccgtacgtggcgatcagcgcctgcgcctcgatcggatcacccagcctcgtacccgtaccgtgcgcctccaccgcatcgacctcatccgaagacaggcccgcgttcgccagcgcctgccggatcacccgctgctgcgagggcccgttcggagccgtcaaaccgttcgacgcaccgtcctggttcaccgccgtaccgcggaccaccgccagcactttgtgcccgttccgacgagcgtcggacaaccgctccaccaacagcatgcccacgccctcggcccagcccgtaccgtccgccccggcgccgaacgccttgcaccggccgtccgccgacaggccgcgctgacggctgaactccacgaacacggacgggcctgccatcaccgtgacgccgccgacgagggccatcgagcactcgccgctccgcagcgcctgcgcagcgaggtggagggctacgagcgaggacgagcacgccgtgtcgacggtgaccgccggcccctcgagcccgaacgtgtacgagacccggccggaggcgatgctgcccgcactgccgtttacgaggtagccctccagccctgggggcgaggtgtgcacccgcccgccgtagtcgtggtacatcacgccggcgaagacaccggtcctgctgccccgcaccgtcgccgggtcgatcccggcccgctcgaacgcctcccacgacgtctccagcagcaaccgctgctgcgggtccatcgccagcgcctcacgcggcgagatcccgaagaactcggcgtcgaagtccgccgcgtcgtgcaggaagccgccctctcgggtgtagctggtgccccactggtcgggattcgggtcgtagagctgctccacgtcccagccgcggccctcggggaagcccgacacggcgtcgcggccggagaacaccagctgccacaggtcttcgggtgactgcacgccaccggggtagcggcaggccatgcccacgatcgcgatgggctcgtccgccgttccggtggccgtggagagggtcgtcggcacggctgtcgccgcctcgccgcctgcggcttcgccggtgaggaagtgggcgagggtaagcgggttcgggtagtcgaagatcagggtggcgggcaggcgcatgccgacggccgagttgagccggttgcgcagttcgacggcggtcagcgagtcgaacccgatgtccttgaacgagtcgtccgcgccgaccgactgtgctccggcgtgcccgagcacggcggcgacctcggtacgcaccaggtccagcaccacctgctcgcgctcggcctccgccagcccggccagccgctgacccagcgatcccttcggcgcggtctgcgccgtacgtcgcgcggtgccccgtacggtaccgcggagccctcgcaggaccggcggcaccgtgccctgcagcccgcccaggtccagccgcagcggggcgacgacggcccgatccagggccagtgccgcgtcgaacagccgcaggccgtccgacgacgggatcgcggcgaggcccatgcgctggatgcgggtgagatcggtgtggtcgaggctgccggtcatggcgctctcgctgtcctgcgcccacaggccccaggccagcgacgtggcccgctggcccgcggcacggcggtgctcggcgagggcgtcgaggaaggtgttggcagcggcgtagttcgcctggcccggcgtgccgagagtgcccgccaccgaggagaacagcacgaacgcggacaggtcgccggacagctcgcccgccaggtcgtgcaggttcagcgccgcgtccaccttcgggcggaacacggcgtccagccgctcgggggtcagcgagccgatgattccgtcgtccagtacgccggcggtgtggatgatcgcggacaggctctgcccgggcccggccaggagtgcacggacggcggcgcggtcggccacatcacacgcggcccaggtgacgtcggcgccctgcgcggtcaagtcggcggtgagctcggccgcgccgggtgcgtcgccgccgcggcggctgacgagcagcagactacggacgccgtgttcggcgaccagatgccgggcgaacaacccgcccaggccgcccgacgcaccggtcagcaggacggtgccggagccgaggccgggaagttccggctccgcgtccggcacggcgactcgaaccagcctgggcacccggacctcgtcgtccgcgtgcaccgcggcctgcggctcacccgacgcgatcaggccgggcagcacccgggcaagatcggcgtcatcaacaccgctgccggccccggcatgggcatcgctggaggtctcgaccagcacgatgcggtcggggttctcggtctgcgccgagcgcaccagtccgcagaccgccgactgggcgaggtctcccccacgcgtcaccagcaccaggcgccccgggcgttcctcggccagccaccactgcaccaactccagcacggcatgggtgacctcacggacccgggtggccaggtccgcgccggtcccggtcgggcagggcacgaccacggcatcggcggcggctgcggcatcggcttcggtgtccgccggcgggtcagtggcccgaagagcggcgagatcctcgtacgtctcgatcctcatgccgtccggcgcggacggcaggctgaccggcgtccactttaggccgaagaccgcgtcgtcgctgccggaaccggcgcgcaactggtcggcgggcaccgggcgcagcgtcaacgagtcgacctccgcgaccggcccaccggtgccatcggccagcaccagcgacaccgtagaggtgccggtaccggcgcgcgataccttcacccgcaggtcggaggctccggcagccgccaggcgcacgccgctccaggcgaacggcaacagcccgtttcccgtcccggcctcgggctcgaccgcgcccagccagacggtgtgcagggcggcgtcgaacagggcgggatgcaggccgtacgcgcccgcgtccgtccgctccgcgccgggcagctccacttcggcgaagaagtcgtccccgctccgccacgcggcgcgcagcccctggaagacggggccgtagtcgagcgccatgccggcgaggcggtcgtagaacccgtcgacgtcgaccggctccgcacccacgggcggccacgcggtgagcgagccgtccacgggccctcctgtggcgacggtcagcacgccggaggcgtgccggacccatgcccgctcggagtcgtcctcgtgggcgtacgcgtccccgtcgtcgatctgcgagtgcacggtcagcggcctgcggcccgagccgtcgtcggcgccgacgtgcacctgcaaggcgacgccgccgcgctcgggcacgagcagcggtgtctccagcgtcagctcttccagcaggtcgcagcccacggcgtcagcagcggtgatcgccagctcgacgaacgcggttcccggcaggagcgcgaccccactgacggcgtggtccaccagccacgggtgcgtgtgcttcgagagccggccggtgagcaggtgcccgacgctgtcggccagcggcacggcggcgccgaggagcgggtggccggcctcgccctgccccaccgcgcgcatgtcaccggcggaggcgggggcgtcgagccagtagcgctcgcgctggaaggcgtacgtgggcagctcgacgcgccgggcgcccgggaagaaagcgtgccagtccacttcggcgccgctgacgtgcagttgggcgtacgcggtggtgagcgcctggggttcggggcggtcggcgcgcagggcgggaatggtgacgatgtctgtgccgtcgtcgaggcagccctggacgagggcactgaggacgccgcccggtccgatctccacgaacgtggtcacaccgagctcgtgcagggtcagcacgccgtcggcgaagcgcaccgcctcacggacgtgccggacccagtactcgggggtgtacgactcagtcagccggccggtgaggttcgagaccaccgggatccacggctcactgaacgtcagaccgcgaacgacctccgcgaactcctccagcatcggatccatcaacggcgaatggaatgcgtgactgaccttcagccgagacgtcttacgaccctgagcagcgaacacctcggcaatcgccgtgaccgcgtcctccgccccggaaatgaccacggaccgcgggccgttgatcgccgcgatacccgctctgtcaatcaggtgcggcagcatctcgtcctcggccgcctggaccgccaccatcacaccaccggcgggcagggccttcatcagcgcggcacgcgccgacaccagcttcgccgcgtcctcgagcgacagcaccccggccacgtgcgcggccgcgatctcaccgaccgagtgaccggccacgtagtccggccggatgccccacgattcgagaagccggaacagggcgacctcgacagcgaacaacgccggctgcgtcgaacccgtctgatgaagagtttccgcatcgacgtcgaccgtggcgtccaaaagcgcgcacacctcgtcatacgccgcagcgaacaccgggtacgccgcgtacagctcacgccccatccccagccgctgcgaaccctgacccgagaacaagaacccgaccttgtccgccgagtgagcgcgcccggcgacgacgttcgccgccggttcgcctgccgcgagggcctcaagacctgcccgcagctcggccgggtcgctgccgatgactgcggcccgatgctccagtgccgaccgcgtcgtggccgacgagaatccggcgtcgacgggcgacacatcgtcggtcgcgaaggccagcagacgctccgcctgggcccgcagcgccacttcactctttgctgacagcacccacggcacgggcaccgggcggtgttcccgggccggctcggccgcggccgcggcgggcgcttcctcgatgatcgtgtgcgcgttggtgccgccgataccgaaggaggacaccgcggcccggcggggcccggtggtcccgggccattgcaccggctcggtcagcagccgcacggcgcctgccgaccagtcgacgtgcgcggtcggctcgtccacatggagcgtctgcggcagcacgccgtgccgcatcgccagcaccatcttgatcacaccggcgacacccgcggcggcctgcgtgtgaccgatgttggacttgaccgagcccagccacaccggccggtcgtcggagtgttcctggccgtacgtggcgaggagcgcctgcgcctcgatcgggtcgccgagccgcgtgcccgtgccgtgggcctcgacggcgtccacgtcggccggcgtgagcccggcggacgccagcgcctgccggatcacccgctgctgcgaggggccgttgggcgcggtcagaccgttggacgcaccgtcctggttcaccgcactgccgcggaccaacgccagcacctggtgcccgttccgacgggcgtcggacaaccgttccaccagcaacaggcccacgccctcgccccagcccgtgccgtcggcaccggccgcgaacgccttgcaccggccgtccggcgacagcccgcgctgccggctgaactccacgaacaggtccggcgtggtcatgacggtgacgcccccgaccagggccatcgagcactcgccgctccgcagtgcctgggcggccaggtgcagggccacgagcgaagacgagcaggccgtgtcgaccgtgaccgcgggaccctcgaggccgaacgtgtaggagatgcgtccggagacgaccgaggccgccttgccggtgagcgcgtagccctcgatctcctcgggcgcgttgcgtagcccgttggcgtagtcctggccgttggtgccgatgaagacaccggtgcggctggcgcggacggacgcgagggcgatgccggcgcgctcgaaggcctcccacgcggtctccagcagcagccgttgctgcgggtccatcgccagcgcctcacgcggcgagatcccgaagagaccggcgtcgaagcggtcggcgccctggatgaagccgccctcgcgcgagtacgtcttgccgggccggtcggggtcggggtcgtagagcgcgtcgatgtcccagccgcggtcggtggggaagccggacatcgcgtcccggccggagctcagcagctcccacaggtcctccggcgactggacgccgccggggaggcggcagctcatgccgacgatcgcgaggggctcgtcggccgcagcggcggccgtcgcctgcgcggcggccgtctccagcccgtgccggccgaggagttcctcgcccaggtgacgggcgagggcggttggggtcgggtggtcgaagaccagggtggtgggcagcctgaggccagtggccgtgttgagcctgtgacgcagttcgacggcggtgagcgagtcgaagccggtctcgcggaacgtccggtcggcttcgaaggcgcccttgcccgtgtggccgagcaccgtggcggcctgctcgcggaccaggtccagcaggatgcggccctgctcccccggcgtggcgccgaggaggcgctggaccagcgcggacacgggtacttcggggctctgcgcggcccgggcgcgtgcttcgagggcctcgcgggcctcgggcacgccgagcagcagcgggcagggccgcgtgccgacgaaggccgggacgaagcgctcccagtccacgtccgcgacggtcatggaggtctcgccgtgggtcagcgcaccgtgcagcacggagatcgcgggaagggccgcgatcgcccgtacgccgcgccgccgcagatggtcaccggcggcgccgtcggccatgcctccgtccgcccaggatccccacgcgacggccagcgcgggcacgccctgcgcccggcggtgctcggcgagggcgtcgaggaaggcgttcgcggcaccgtaggcgccttggccgccgttgccccagacaccggtcatcgaggagaagagcacgaaggcgtcgaggtcctgacggtcccgggtgagctcatgcagatggagcgctgcgtccaccttggggcgcagcacgtggttgaggcgctcgggcgtgagcgattcgaccaggccgtcgtcgagtacgcctgcggtgtgcaccacggcgttcacgatgtaccggccgaacaactcggcgagcgcgtcgcggtcggccgcatcgcacgcgacgacggtgacctgagcgcccagctcctccagctccgccttgagttcggcggcgcccggggcgtcggggccccggcggctggtgagcaccaggtgctcggcacccgcaccggcgagccagcgggccacctgcccgcccagcgcacccgtaccaccggtcacgagcacggtgccgcgcggcgaccagggtgcgtccgccggtgccgcgctcagcggcgcgcgcacgaggcggcggccgtacactccggaggcgcgtacggcgagttggtcctcgtcggcctgggccagcaggccggccagtcgttccagcgcgcgggagtccagctcggcgggcaggtcgacgagcccgccccagcgctgcggctgttccagggcgacgatcctgcccaggccccagagctgggcggagacggggtcggtcagcagatccgccgtgccggtcgacactgcgccgctggtcaggcaccacagcggggcctcgatcccggcgtcgccgagggcctggacgagcaggacgagccgctggagggcgttcgcccccgcttctccctgtgctgcggcgaacaggatgccgtcggcctgctcttgcccggcgtcggcgaaggcccgggcgagcgcgtcacggtcggtgtcctcgcccacggcgaacggtacgagcgcgacgccgagttccgtgagcccggcgcggatcgcctcggtccacgcggtctcctcggagaccacgtagagccaggtccccgacggagcggcccggaccatgtcatcgagcggctgccaggtgatccggtagcgccagccgtcggtggtggactgctcgcgccgcttccggcgccaggcagacagcttggacgcgaccacgtccagttcggtgggctccagtcccaggagcgcaccgagagatgcccggtcctcgctctcgacggagtcccagaactcggcgtccatcgcgtccggggcgccggcggtcgccgcccgaggcgcgtcgagccagtagcgctcgcgctggaaggcgtacgtgggcaggtcgacacgccgggcgccagggaacaacacctgccagtcgggtgagatgccgtgggtgtgcagccgcccgattgcggtgacgagcgcgtacggctcggggcggtcggcgcgcaggacgggaaccgtgacgatgtctgtgccgtcgtcgaagcagccctgggcgagggcgctcagcacgccaccggggccgacctcgacgaacgtggtcacgcccagctcgccgagggtctcgatgccgtcggcgaagcgcaccgcctcgcggacgtgccgcacccagtactcgggcgtgtacacctcggccaaccggccggtgagattcgagaccaccgggatccgcgactcactgaacgtcagaccgcgaacaaccgcagcgaactcctcgagcatcggatccatcaacggcgagtggaaggcgtgactgaccttcagccgggacgtcttacgaccccgaccggcgaagatctcaccgactgcggtgaccgcgtcctcagcgccggaaaccacaactgaccgaggcccgttgaccgccgcaatcccgaccccgtcggtcaggtgccgcagcacctcgtcctccgtcgcctggaccgcgaccatcgccccgccgtcgggcagcgcctgcatcagtgcggcacgcgccgacaccagcttcgccgcatcctcgagcgacaacacacccgccacatgagcagccgcaatctcacccaccgaatgaccggccacatagtccggccggatgccccacgattcgagaagccggaacagggcgacctcgacggcgaagagcgcgggctgcgtcgtacccgtctggttgagctcctcggagtcgacgtcgacgggcgcgtccagaaacgcgcagacctcgtcgtacgccgcagcgaagacggggtacgccgcgtacagctcacgccccatgccgatccgctgcgaaccctgacccgagaacaagaacccgaccctgcccccgacggcaccgcccaccggagcagcgccggaagcgccggaagcaagcgcctccagcccctgccggagctccgcgagatccccgcccacgaccgccgcacggcgctccagcaccgcacgcgacgtcgccagcgacaacgccacgtcctccggccgaaccccggcacccccgacgccctcggcgtccaggaaggacaacaaccggcccgcctgctcccgcagcgccacatcactcttcgccgacaccacccacgggaccggtccggcaacggccgtcccgcgggcgggctcttcgctcgtcgcggcctgctcgacgatgacgtgggcgttggtaccgctgatgccgaaggacgacaccgccgcgcggcgcggcaggtcgcgcgcgggccactccaccgcctcggtcagcagtcgtacgccgcttgccgaccagtccacgtgcggggtcggctcgtcgacgtgcagggtccgcggcagcacaccgtgtcgcatcgccatgaccatcttgatcacgccggcgacgcccgccgcggcctgcgtgtgaccgatgttcgacttcagcgaacccagccacagcggccggtcgccgtcccgtccctggccgtaggcggcgatgagggcttccgcctcgatcgggtcgccgagcagcgtgcccgtaccgtgcgcctccacggcgtcgacgtccgcgggcgcgagtccggcggctgccagcgcctggcggacgacgcgctgctgggaggggccgttgggcgccgtgagtccgttcgacgcgccgtcctggttgaccgcgctgccccgcacgacggccagcacctggtggccgttgcgccgggcgtcgctgagccgctccaccaggagcatgccgacgccttcggcccagcccgtaccgtccgcgccggccgcgaacgccttgcagcggccgtccgccgacagtccgcgctgacggctgaactccacgaacatgccaggcgtggacatcacggtgacgccgccggccagggccatggtgcactcgccgctccgcagcgactggacggccaggtgcagggcgaccagagacgacgagcaggccgtgtccaccgtgaccgcggggccttcgaggccgaacgagtaggccacgcgccccgaggcgacgctggtcgtcgtgccggtcagcagatagccctcgacgccgtcggccggctcgtgcagccgggggccgtagtcctgtgccgtcgcgccgatgaacacgcccgcccggctcccgcgcagcgtggccgggtcgatgccggcgcgctcgaaggcctcccacgcggtctccaggaccagccgctgctgcgggtcgatcgcggcggcctcgcgggggctgatgccgaagaagccggcgtcgaactcggccgcctcgtgcaggaagccgccgtgccgcgtcgaggacttgccgggcgtgccgggctccgggtcgtagagtgtttcgacgtcccagccacggtccgtcgggaatccggagatgccgtcgccaccggaggcgagcagccgccacaggtcctcgggggagctcacgccgccgggcaggcggcagctcatggccacgatggcgatgggctcgtgggggtcggccaccgtcgcgggcgcggcggccgccgcgtccccgccgcccagggactgggcggcgagatggcgggcgagcgcggcaggggtcgggtggtcgaacagcagcccgctgggcaggcgcaggccggtagcctcgctgagctggttgcgcagttccaccgagctgagcgagtcgaaaccgaggtccttgaacgtccactcggtctcgacctggcgggcttcggcgtggccgagaacggcggcgatgtgtgcgcggaccatgtcgagcacggcctcgtcgcgctcggactcggccagtccggccagccgccgacccagggctccgacaggcgcgctgtcagtctcggcgatggcgtccggctgcggagccacaggagcccagccggtggtggcgacgggcgacgtcgtgtcgccgtccagccagtaccgctgccgttcgaacgcgtaggtggggagcgcgaccttgcggcgtgcgcctcgcccgccgccgaacagggcgtcccagtccggctccacgccgtggacgtgcagcgaggcgaccgccgccagcagggcctgcgcctcggggcgacgggtgcgcagggcggggacgaacagggactcgctgtcagcgccggcgcgggccatggaggcgagcacgccgccagggccgagctccaggtacgtgcggacgccctgctcgtcgaggcgggcgacgccgtcggcgaagcggaccgcctcgcgcacgtggcggacccagtacgcggccgtgcacccttcgtatcccgagggctcctcggacagtcggcccgtcacgttggacacgatcgggatgcgcggggcgtggaaggtcaggccctcggccacgttgcggaactccgccagcatgggttccatgtgcggggaatggaaggcgtggctgacccgcagccggctggtcttgcggcccagggcggcgaaggcgtcggcgatctcggtggcgaggtcctcgtcgccggagacgacgacggagtccgggccgttcagcgcggcgatgctcacgcggtccgtgcgctcgccgatgcgggcgcgcacctcgtcctccgcggcctggacggcgatcatggcgccgccggcgggcagcgcctgcatcaggcgaccgcgcgcggccacgagggcgcaggcgtcggcgagcgagaggacgccggccacgtgcgcggcggcgagttcaccgatggagtggcccatcagcacgtcgggggtgatgtcccagctctccagcagccggaacaaggccacctcgacggcgaacagtgaggtctgcgtgtagagggtctggtcgagttcggcggcttccccagtgcctacgggtgcgaacatgacctcgcgcagcggccgcggcagcaaggggtcgaggtgtgcgcacacctcgtccagggcggaggcgaacgccgggacggactctgccagttcgcggcccatgccggcccgctggctgccctggcccgagaagaggaaggcgagctcgccgcgcgggcccgcgcggccagtggtcagtgcggcgtcaatgccgccggtggacagctcgcgcagggcgcgcaggaagtcgtcacgaacctcgcccacgacgacggcccggtgttcgaaggcggtgcggccggtggccagcgaccagccgacgtcgggcagggcgagaccgaggggcgcctcggtgtgggcgagcagtgcggcggcctgggcgcgcagcccggatgcggtcttggcggacagcggccaaaaggtcggagccgcgcccccgcccgccgtcgcaccctcacccgcctccacagccgcgcccgacgccagcacgatgtggcagttggtgccgcccatgccgaacgagctgacgccggcgagcagcgggcggccgtcctcggcggcccattcgctgtgctcggtctgcaccctcaggttcagccggtccagcgggatcgccgggttcggcgtcccgaagttgaggctggcgggcagttcacggtggttgagcgacaggaccgccttcagcaggccggtgatgcccgcggcgccctccaggtggcccacgttggtcttggccgagccgacccgcagagggcggccgggctcacgtcccgtgccgagcactgcgccgagcgcggctgcctcgatggggtcgccgaccttggtgccggtcccgtgcagttccacgtagccgacatcggcggggttgactccggcccgttcgtaggcgagccggagcacctgttcctgcccggactgcaggggcacggtcaacccgtcgccgccaccgtcgttgttgaccgcactgccgcggatcacgcagtagacagggtcgccgtccgcgacggcccgggcaagaggtttgaggacgacgatgccgccgccctcgccgcgaacgtagccgttcgcgcgcgcgtcaaaggtgaagcagcggccgtccggggacaggccgccgaacttggcggcgcccagggcgctctcggggacgatgttcaggttcacgccgcccgcgagagcgatcgtcgattcgcccttgcggagactttcgcaggccaggtggaccgagaccagagaagaggactggccggagtccacggtcaggctggggccgttcaggccaaggaagtacgagacccggttcgcgatgatgctgcggtgcaggccggtgacggtatgcggggagatggccgtgagtccggagcggtggtgcagcgtcgcgtagtcgtcccacatggcgccgacgaacactccggtgcgggtggagcgcagcgttgcggcgcgcacgtgcgcgtcctccagtgcttcccaggccaactccagcacgagccgctgctgcgggtccatggcggcggcctccttgggggagagcccgaagaacccggcgtcgaagtcgccgatgctgtcgaggaagccgccccggcggatgccggtcctgtcgggtgcggacgcgtcggccaccaccgccccgtcccaccggtccggagggacgtcggtgatcgcgtccgcgccctcgctgagcagccgccagaaggcggccgggtcggcggcccccggcagtcggcacgccaggccgatgacagctatgccatcggccgaatctgccgaagccgaacagtcccgattccccgttgcgttgagctcggactcgaccatgttgcgctccacccacccacacagagaacgaaaggcaccgcaccaacgtcggccgctacacgggcgatcggctcgaccaggcggcaacaagctgcagtgtgaccctggtttcgctcccgcggcagcgcgccgccgctgcagcagatcaggtttaggggaatccccaatgggtgacgtgcacgagcattgacagtcgggaaaatctctaaggagaaccctaggcgctagctgtgagagaaacacggcatatatagccctggcccgatttcctctgatgaagaggtcccactttcatgatgcatttgcaagcggccgagaatcactaccgacctcgccaccaagatgatctccgcctgcgaaaatctcgccagagccacgttcacgtgtacgccgacacctgcatgaacgccgacccagccctcccgcacctactacgacaagaacgagcccgcggcaagacccacacccaggccctcctccgcctcgcccgccaacgcatcagcgtcctgttcgccatgctccgaaacggcaccttctaggccctcggggaggatcggaacggccaatagcgacatctggccgatcttgattccagttcgatgactcgccctgtttccgctgatcagggcccctacgttccgggtcatgccagttgaatttctctctcatgaccaggtctcgcgctacggccggttcgcttcggctccgacacccggggagctggagcagttcttccgtctggacgcgaaggcgttggagtcggcgcggtcgaagcgggcgccggcgaaccggctggggtgggcggtgcagtggggctgcgtacggatgctcggggtgttccccaccgaggacctgtccgtggtcccggaggtggtggtccgcttcgctgccgaacagctgggtgtcgatccgggcgagttcgccgcgtacggagcccggcggcagaaccggtacgagcacgcatgggagatccgggacgcctacgcgtaccgggagtccccggcggcggaggcgcaggtgcgggagtttctggcgacgcgggtgtgggcgtcgtgggaggggccgcgggcgttgttcgaccgggcggtggggtggctggtggacaaccgcgtgctgctgccggggattacgacgctgacccggctggtggccgaggtccgcgcgcaggagaacgctgcgttgtaccggacgctggatgaggcggtgcccgagaagctgcggcagtcgatgcgggatctgctgaaggtcccggagggcagacgggtctcggagctggagcggctgcggagatccccgatgggggtgtcggggtcggcggacaggctggcgttcagcgagcggatccggatggaagcagtcgcaatgttcaccgctgggccgggcagcacggacatcgcgaaggagttacgggtcagcgtccagtcggtccagcggtggcgttcaggcctggcgggagaccggccaggacggggtgcggtcccgcagcccgtctcggtcgagctgagcgagaccctgttcgccgcgctcgatgaggaacgggccaagggcttcgctccctcatggacaatacgttaccttcaccacgatttccccatttttggacagaggtatgcctataaatggtcacagggctgcttgcactccttcgggcgatcagcgcagggatacagagaccagtgacatgggagaagctttgatcacgctgtgtacacgaagcaccaggctggcggctacggccggcgtactcggcggtgtactcgcagtcacggccctcggcggtacgagcaacgctgcgaccagcggcaacggtgcagggaaccacccgacatcgcaggcgaggataaatcaggcgggcgcccaggaagcctccgacgcccgcatcgagatcacgcccgggcaaggcacctacagcgtcgggaccaaccacccggtcagtgtcaccgtcaccagcggcaagctcaccaaggtgaccatgaccgccgtcgcgaccggtgccgagatcccgggcactctgtccacggacggcacctcctggaagccaaacggccggctggagcgtgccaccaagtatcagatcgccgcagaggctggggacgtcaagggccgctccaccaccggtagcgccacgatcaccactgtctccccggccaacgacttcatcgggcacctctcccccgaggacggctcgaccgtcggcgtggccatgccggtgacggtcaacttcgacaaggcgatcagcgacaaggcggcagtgcagtcggagatccgggtcagctccagcagcggccagcgggtcgtcggtcactggttcaacgaccaccgcgtggacttccgccccgagaattactggaggcccggctccaccgtcaccgttacgctcaaccgccacggcatccagaagacggtcacgttcaagatcggccggagccagatcagcaccgtggacgccaagacgaagcagatgaccgtcgtccgggacggcaagacgatcaagaccatcccgatctcgtcaggcagccctgagcacccgacgtacaacggtcagatggtgatctccgaaaagttcaggcagatccatatgaatggtgcgagcgtcggcctcacggagaagaacggcaagccctcgtacgacatcaaggccgtaccgcacgccatgcgcctgaccgactcgggcacgttcatccatggcaactactggggtaccgactctgtcttcggcgaggccaacaccagccacggctgcgtaggcctgaaggatgttcgaggcgacagccacggcaggcagcccgccgcgtggttcttcgaccactcgatagtcggtgacgtcgtgatcgtcaagaactccgaggagaagaccatgttggcccctgacaacggcctcagcgattggaacatgtcgtggagcgagtgggtcgcgggcagcccagccacctgacaccacgtcacctccacgcagccgaaccggcatcccttccgccaggcggtggccgacaccatgtcggccaccgcctgcggcgtcaggacgcttgaacagccctcggcccgggggccccgcacctggtacgcggggaatgggtaagccgggttcagcgcgcggcacggagaagcggaccggtggcaacaccggcatcgcactcagtgtcgactcaacaggcaccctccccgcaggcggccggttggtcgccgcgcacactggatcagatcaagaggaaggctgggagggggcgccgctcggcctcgtgcaacgtgaccagcccggcacctgcgggcagccgcaagcgccgaagccggtcactccggttggcgctctgggcccccgcagtgaggactgttcggtccgcctcggcgcggatggagctgaggtaggagccgtcgtccagaacttggagcccgggcacggccgcgctgctgcggaggcgccacagcaggtcggcgccggtggcgcgggcggtctgccacagctcgaagccgtaaaagccctgatcggccagcaggagcttcccctccccgagctgggggaacagctgccgggacagctctgctcgcccgccgacagcgggtccgatgacagccccgaacaccgcatgggtgccgcattccgccagtgccaccaccctcgcctgcgcgaacgcgctctccccgcggccgccggcctggcggccgaagaactcttcgttggcccatgtccgccacatccagcgtcgtgccgtccaccgcgaccagacgccagtgccggtactcggcacgccgtctcgggcacagccaccggccggcacacccgggcgagcaacgccttcaacggctccacgcccagccgccgacgagcccgcccgatcacggcgcccgccacgaccaccgggcctcgcccagcagccgggcgacctcttcgtatccctggccgaagaacaggcacctcgcgaggatgaagtacaccaccaccgcgccgacagcagactgcgctgttcgacccagccggtctcggcgatcagaacgccccgccgaggccgcagaccgcgcggtccccggacactgggaaggcgatttgatcatcgggacggggcgctccgcgatcggcacgctggtcgagcgcagcagccgctccacgctcctggtgcacctgccccggctcgagggctggggtgagaatccgcccgtgaagaacggcacctcacttgggggctatggcgcgatcgcgatgaacacagcgctcaccgcctcgatgacgcagctgcccgagcagctacgcaaaaccctcacctgggaccgcgggaaggaactctccggccatgcccagttcgccctcgacaccgggacgaaggtgttcttcgccgatccccactcgccctggcaacgaccgacgaacgagaacacgaacgggctgctgcgtcagtacttcccgaagggcaccgatctctcccggtggtcgtccacggacctcgaagccgtcgccatggcgatcaacaaccggccccgcaagaccctcggttggcggacgccagccgaggtcttcgaagagcagctacgctcgctgcaacagcccggtgttgcaacgaccaattgaactcgcccagtacacatccgtgaagctgacaactggccttgtgagagcgggagttgaggcatctatgggctcggtcggggattcgtacgataacgccctcgcggagaacctttggatgctcatcaaaaccgagtgcatccgtgggcgcaccttcaccacccgcgccgaggccaacctcgcgctcttcgagtacatcgacggcttctataactcccggcgcatccagaagcggctcggctacctcagccccgtcgagttcgaggagaagcactacgccgaccaggcaacggccgaacgaacgaacctgaaaccccgtcaacccgccctggccagctgatcagcacctcccgcacaccgggggaagctcacggcggccatgaggtcggtcatggcgatgtgggtcatggcttcggagtggacgcgcagggtcttgtagtcgcgggcaagtcgacggttgagcatgagccagccgtaggtccgctcgactgcccagcgtttcgggatcaagtccggggcttgcgttgatttccatgtcgatgccgagggtggcggcgtggtcgacgaggtgctgacggtagccgccgtcgacccaccccttgcggatgccggggtgttcggccgcgacctggtccaggagtctggtgccagcgacggagtcctgcacgctcgccgctgtgaccagcacggatggcatcctcgagagggctgtgcctgggctttcacccctgctgcacgagtgcctcgcatccgcggtcgagcgatgccatgaactcgcggttggccgcacgggcagcggcaaggtcgtcgtcgcgttcctggaccttcagctcgggacgaatcaccttctgttcgagggcggcgatccaggccttgagctgctcggggtcgtcagggccgccgatgccgaactcgcggcagacctcagcggagcgctctgctcaggcgcagttcaggtcggcggacctgggctgcgagccgtgcggaacgggcttcggcggctgcgcggtcggccttcagcgaagcgcggtcggcccgtgcgtgaccgccgacgggtgactcggcggcctgggcatggactcaggtggcttcgttcactttcgtcagcagcgtggaccaatgagctcgagcaacgcttggtaatcaacgggccgacagatgttcacgcgaaatgaccgcacatccagcgcgtggcggaccgaggccgctaccgcagtgtgtcgaccccgtagaagccggtcagcttctgcggggtgaccaccgcatctgccccacgcccaggagaaccagtccagagagcagcagcacgttcatgctgaagaatcggatctcccaggacggactcggcacgattccgaagtagaacaagccctgcacagtgcagggcgtgcccaccaacagtcctccaagtccatagacccgcggtcgggcgacatggcggcgcgcccacgacaacgtccaccccgtgcggatcgacacagttcccagggcgatcgccagcacgcccaggaccatcccaagtccaacgaaccaatccacggccacccctccggcttgcgaacatgcccacccggggccgcgtcgccgcgcaaacggtacacctgccgtgtctcgcgagttcagtgcagttgtgcgggtagtcagtccgatgccggatggtggggtgtcggttcatcggcctcggcctgttgaaaggtgctgtacagcagcccgagtgaggggacgagcaggacggcaccgcaggccaggacgatcaggcacgcagacaggacggcaggctgggaggcggcctcgtccagggtgaggctgcccaccagcatggccgggtattgggccgcgccccaggctgcaccagaggatcgccgcgactgcaagtgcggccgctgcctgggccgccacgtattgttgtttccccaactgcccgacgacgaggtgaccccgcgctggcccgcaacttcgcgcgccgagcgacgctcagcgggctggccgggcggccggctctccctgaccagcagaactccggccaccttcaccctgctggtcccggtccacggagccgactccgaggccgacgcctcgaccgagtaaggacgcaccccggcagctctacgacccgtgtggtgctcgccgcggcagtgcggtccgcggcagcaggcggggccatgccggtggtcaccaatggggtggtgctctcgcggtccccataaacacagcgcactgcgctcgcttcgcgctgtcgagcatgcgagacgacttcgcccgcgccaccgcgatctgagcggtggcaaaagcaccgctccgactcaggtcactggatgccggtggctcgggtcaccatgcgttgatggctggcgcgtcgggttcgtgctgccgccacgcctcgttgaggcgcgcgagccggtccgcggcggcgatgccgcgcagggacgcgaccttgccgtcgctgacttcgaacgccacggcgcccacgacccggtcgtcgaccacggcgaggacggccggggagccgttgaccagcgcgatatagaacgcgggcgagccgccggccagccggcgcttcgccggcgtgggcttgaagccggcccgcacgtaggaggcgacccgctcgcgcgtcttgtagtgcagcagccgcttgctcagtccggcgccgtccgagaccgccgtcacgtcgtcggtgagcagcgccaccagccgttcggtgcgccccgacgtggcggcggcgaggaactcctcgacgacccggcgcgcggacgcggggtcggtctcgctgcctcggcggcgctcggcggcgacccggatccgggcccggtggacgtgctgctggctcgcggactcggtgatgtcgaggatcccggcgatctcggcgtggctgtacgagaaggcctcacgcagaacgtagacggcccgctcgaccggcgagaggcgctccaagagggtcagtacggccaaggacaccgattcgcgctgctcgaaggtgtcggccgggccgagcatcgggtcgctatcgaggagcggctcgggcagccaggcaccggccgcctgctcgtggcgcgcctgcgccgagcggagccggtcgaggcagagattggtgacgaccttggtcagccacgcctccggcacctcaacccgttcgcggtatggggcctgccagcgcaggaacgtgtcctgcacggcgtcctcggcgtcggcggccgagccgagcagacggtacgcgagcgaggccagccggccctggctagcctcgaaccgatcgatggctgcgatgtccatgcggagcagcctaggcggcgaccttcacaccggcccggtcaggcgcggtggccaggcggcgcttgcgcttcggcatgccgaaggtcgggtgggcgatgctccacccggcgcccttgagcacgcccgacttgagccgcgcggcggtccggccgcccaggtaccagggcttcgaccggccgtccccgtccaccatctggaagatcgcgtcccgccgcccgaggctgatgtggttgccgtggtacttcagcccggtggtcgggacctcactacccgtcaggcgcgcgatgatcgcggcggttgcctgcatgttggtgaagccggccgaggcgcaggacatcggcagcggccggccgttgtcgccgatcgcgtaggcgcagtcaccggcggcgtagacgtccgggtgcgagaccgagcgcatggtgcggtcgacgacgatctggccggtctcggcgacctccaggccgctggcggccgccatggggtgcacggcgaacccggccgaccacatggtcacgtcggccgggatggacgtaccgtcggcggcgatcgcccgtgtcggctccacggcttcgatgccggtgtgctcgtggacggtgatgccgagccggtcgaacgcctggcgcaggtgacggcgggccttcggggagagccaggcgcccagctcgccgcgggcggcgagggcgaccgagaggtcgggccgggactcggcgaactcggtggcgctctcgatgccggtcagcccctcaccgacgaccagcacggtgccgccctcgcccaggccggccaggcgctcgcgcagacgcagcgccgaggaccggccggtcacatcgaaggcgtactcggccacgccggggacgccatggtgggcgacggagctgccgagcgcgtagagaagcgtgtcgtaggcgagctcgccgtcgccgtcctcgccggtcacggcgacggtcctgcggtcggggtcgacgccggtgacgcgcgccaggcgcagccgcaccccggtgctcgcgaatacgtcggcgaggttgcagaacgcgaggtcctggccgatcgcgagctggtggagccgcatccgctcaacgaagtcgggcacggcgttgacgacggtgatctcggtgtcggcgggggagagtcggcgggccaggtttccggcggcgaaggccccagcgtatccggcgccgagtacgacgatgcggtgcttcatggcgttgctcctgtctcgttcgcgtgccccttgaacgagacggcgtcccgattgctgacaggagccgggtgtgacgcgggtcaccgaactgagacgtgcggatgagcctccgacaggcgctcggccacacatctgccgtttgagcatcttgatccggtcgcgtgtccttcgacgacgccggagctctaggtgctcggcgcggagccgggccgctgggcgtcgttgcgctcgatgcggccggtgccgtgccgggcggaggtgcggccggactggaccagggtgcgagccagctcgaccggttcggccccccaccaggacgtacgccctgggatctgttcgggatcggcatacgggacggcgatgtgccggggtgcgccgagcccgaagcccgcctgtaacagggcgtgcgcgtcctcgtcgctcgcacaggaggtgaaccagtcggcgtggtggcgcagctggctctcccggctcaccccgccacggcgcgcctcggtgacgcggcgcagcagggcaaggacggagcggatcgcggtgacggtggcgtcctgcagcatgtagtcccgtggccacgtactcccgtgaccacaccggtcagcgactcccgtacgacagaagctgtttcgaccgcgccgtagacccaggccggtcctgctccccgcattagcccgtactacaaccagggtcgtcgcattcccctccaacgtgccgtcgaggggaggtcggtggacagggtgtagacggcggcctcgaggttctccaacagcggttcggtggtgtgccttacttgttccgatgcccgccgggcagcatctcctgcaccttcgccttgaagccctgcttcaccacgcccgcccggtcgctgtcaccctcgaggatcgcggtggccgccgcttcgatctgctccagcgtggcgtgcggcgggatcggtggcaccgccgggtccgtgcggaagtcgagcacgaatggccggtcgcaagccagcgcctggcgccacgcactctccacgtcgcccggcttctccacccgcacgccgcccaggccgagggagcgtgcgaagtccgcgtacggcacctccggaagcgactgcgagggcaggaattgcggtgccccggacatggcgcgcatctcccaggtgacctggttgaggtcctggttgttgaggacgaaagtggtcggagatcgccagtggctcgaagccagtccgctcggccgcgcgggcctaggagagcagttcggccggagtgaactcctcggaggagaggaagtagccgtacgtcgccatgcgtcgccgttccaggaactggtcgcgcggtctcgggtcctgctgtgggtggcgggtacccgcccgaggctgagccgaacggggggcacagtacggactcgcgtcgcggcgtcgtgccgcagtccatgcgacaaccgagcgtgaggcccgcatcgccgcgtttcgccggctcccttgctacaacagccgacgccttcattcccggctcggacaacgcagtccgatcgcctacgaaacgccctgggctgctgtaccgctggatgaaaccgaccggtcggaccaccccgtggatgtgagaagccgggaggagcgggattcctcacgtccacggggcgtggagcatcggtggctccatggaccgtcggtcgtgtccgagctggtttcgggtcagacctgcccgcgccaggcgccgctttcctggccccgattttcgatgaaggacttgaaccgcttcaggtcctcggagacttggtgcttcaccacgccaagcttgtccccgacggcgtcgacgacacccttggagtcgtggtccatttgcagcatgaccttggtgcgccggtcgtccagtcggtggaaggtgaccacgcccgcttggtgtacatcaccgccgaccgtcgtccatgacacctgttcgtccgggatctgttcgacgatttccgcatcgaactccctggtcacgccgcctaccttcgtcacccagtgggtgagcgtcgcggtctgctgttcaatccgctccacaccacccatgaactgcgggaactcctcgaattgcgtccactggttgtacgcggtgctgacgggtacggcgacctcgatggattcctcgaccttggacacagcactcctcaagtttggggacgcttacctgaatccgccgcgtaccccgcaggcatacacgtacacgtggccaccctcggtacccggcccgcacggtcgctcggttgagcgtttttgccgtgcgggcccgacagcaacggagtgggcatggcacagcgcagtgttcggaatctccgtcgctgaaccgccgccggagaaatcgaccggcacgagggtgcggggagccgctcctcctcgcccgaaaggctgcttcgagggggcagctctgtctgggcccaccgccaccgcagggatattccgctgtcctgaccggtaaagagagatcgggggggccgccccagcacgctctttgcgccggggaacgtgctcccgactggctacgcttgagacgcagagcctcctggtggcaaccaggctggacttcatggccgaagtgcgtcgcacgcgcgcaaggaagtactcgacgccatccggccgccgcgcatcgtccaccgcggacccatacacgccgtgcgcgcagcccaccacagtctgcaggaactgaccgatgcgtccagccaggtggtgcaacggatcaaggctggtgagcgcgcgggtatctgctcggggcgtgcacccgtcggcgcgactgctccctgaatgatcagggctcaccgccgctcgagctctgattttgtcgaacgaggggacttcgaggaacaccttcgatgacctgcgctcctggcgggcatcgagctgggtggttcttcgttgcggatgccggtcaggcggaggacctcgatcgtggatcgtggcgaaggccccaacgcttcctctacttctcgagcttctcgaccgttcgctgaatgatccggcgggcagcccagaaaccgaacatcgctcggggcgatggaggccggtcatgcgcattgacttgctaagcgttcagccagtctcctagggtgaacgccacacgttggaggtcgccatgtcagagcgccacgaaccccgccacgaacccgccggacagacccgtccgcggctggtgcccctccccgaggagcactgggatgcaaggacccggaagctgttggccggcgcagcccacgaccccggagggcggatcccgaacatcttcacgacactggtgcgccatcccgatctctacgagcagttcatgcccttcggaggccagttgctccgcaggggccgactaccagcgaggctccgagaactgctgatcctgcgcacctcctgcaacaccggcacccggtacgagtggggacggcaccttacgctggccaaggccgcgggcgtcacggatggggacatcaaccgcatcaccgagggaccggaagcgcccggctggacggacctcgagaggcacctgatccgggcggcggacgagctgaacagcggtgcaacactgtccgacgccacctgggaggcgctgaccgaacacttcggcgacgccgagctgatcgagatcgtcatgctggtggggcagtaccacatggtggccttcttcctgaacgccaccggtgtggaattggaccccggtttcgacagcacaggcttcacggaaggggaccggaaccatgggtgaaggacacccggagcaggcggcccctcggctggccggccgcaaagtgctggtggtcggtgcgggcacccgccccgacggcgacccgcgggcacccgtcggcaacggccgggcgatcgccgtgctcgccgcccgtgagggcgccgacgtggcatgtgccgacgtggccgccccggccgccgccgcgaccgccgaactggtccactcggagggggcattgagcgtggccgtcgtgggtgacgcgacggatgccaagcagtcggccgccatggtcgccgaggcggtccgccgtctgggcggactggatgcgctcgtggtcaacgtcggagtcggtctcggcaccgggctggatggctcatcacccgaggactgggaccaggtgctctcgctgaatctgcgtgcgccctttctggccgccaagcacgccctgccggcgatggccgacggaggcgccgtcgtcttcatcggatcggtcgcaggactgcgcgccgccacgaactcgccggcctacgacagttccaaggccggcctgttcggcctcacccgccatgtcgccaaagagggcggggcgcgccggatccgcgccaacctggtcgtccccggtctgatcgacacccccatgggacgacaggcctcggcccaacgggcctccaggaccgcctcgttcgagcgcatcccgttgggccgccagggcaccgcctgggaggtcgcggaggccgtcgcgttcctgctctccgaccgcgcctcctacatcacgggccagagcctggtggtggacggcggactcagcgccgtatgacgcacggcgccccggcccccggccggccaccgcccaacccgggcgcggtcgaccgggggctcagtcggcgccccgcgtggccgtgagtccgagcaccagcgtctcgcgggcagcccgtgcgatgtccaccagacgggttcgggcggagtccagttgatactgaaggagcacgccgcgggcgatgctctccaccaggaacgcctgcgcgaccacgtccacgtccgggcggatgctcccatccgcgatcccccgcctgaggtcctcctcgacgccggtgcgcacgagactgagatgctcggccatcaagtccttcatcccgtcggcgctgccgaccgcctcgacgaggagcaccagcaacgcccgcgcccgcacccccggctccggctccgccagccgggcgaagagctggtcgagcttggccaaaactgattcgagcccgttcatccgggcgtacccgggctgcgaccggagcaggtcgatgaacgtctcacgaatgtcggcgaccacggcttcgacgagcccggccttggacatgaagtggtagttgaccatgccccggctgactccggcacggtcgccgaccttcttcaccgtcaggccgcggtagccctcctccgcgaggatctccagtgccgcgttcaggagccttcggcgggaggcctctcgctggtcatcgcgcttggtcggggggcgtcgggccgccacggttggttcgctcatcggacctgcagtatgccatcgacggggcggccctctggcctgtggcgaccgcgccagtggtcctgccgctacctcaagcggacggtaaccgcctcggccgtcgtcgtggccgacgcccatggcactcaagcagctgccgctccgtacagccgcgccacctccattcggccattctccccgtcggtcgtggacacacggcgttctgaatggaacgctcgctccagaccgcgggcggtctcacgtggcacagtccgtcggcccacgccgaccgcgttcctcgcacgagccgcacatcgcgcaccacacgaagtcctcgcggcagccgagtcccggcacgcccatgcctcgcgtgaaaggtgcaccgcatgaaggtcagagccatcccgacagcagtcaccgccgctctccttgtcactgcggcgcatcccgccgccggtgccgccgcccccgccgaagccgtgccgacgaggttcaccgtcgacaccacatccgacgcggtggacgccgacccgtcggacggccggtgccgcaccgcgtccggcacgtgcagcctgcgcgccgcggtgatggccgccaactcccggccgggcagcacgatcgcgctgccttccggccgctaccggctgacgatcccgcctgacccccggctgatcaccggcgaccatcccgacccgaccactggcgacttgaacgtcgacgcgcccaccacgattaccggcgccggtgcgcgggctaccgtcatcgacgccaaccacctggaccgggccttccgcctgcgggcggacacccgtatgtccgatgtgacgatcacggggggagaggcaaggcagcgggaacttcccttcaccgacaccgggggcggcggcatcgccaacgaacggcatctgacgctgcgtcgggtcgcggtgaccgggaattccgccggctatgggggcggcgtcttcaacgtcccggactcccacctggatctcgtcgacagcacggtcagcgggaacgccgccggagaggccggaggcatcaggttcgacgacagcggcactgtgacgaactcgacgatcgccggcaaccgcgtgacggaccccggcgaccgccccggcagcctcggcggctacggcggaggcatcgacatccgcggactgggaaccgtggaaatcctcgactcgaccatcacggggaaccgttccagccaccacgggggcggaatcaacatcgcccccgcctacctcgacagcctgcccgcaccgatccccgacatcgtcgatctgcctcttggacgtctggtcctgcgcaactccatcgtcgcgggcaacaccgccgactgcgcgaaggccttcgccatcatcgcgtctcgaggccacaacatcgacggcgacggcagctgccggctgaccgccacgggcgatctgccccgccgtgacccgctggtggggccgctcgcggacaacggcggccccacagacaccacggcgctgctgccgggcagccccgccctcgacgcggccgacggctgcccagccaccgatcagcgcggcgtcgcccgcccccagggcaccgcctgcgacatcggcgcctacgagtacacgccatgaccccctgtctccgcaccggcatcaggaggatgcgatgagatcttcgagctcgcgccccgccctggccaccgccgtgaccgtcgtagcggccctgctgctgtccctcaccactcccccagtcacggcgcatgccgatgccgaccatgactccctggtcgtgcgcaccgaccgcggctgggtgcgcggggcagccggccgcgaccgcgggcgaatctttcaggggattccgttcgccgccccgccgacgggtgacttgcgctggcgtccaccccgacccgccgcacggtggtccggcgtacgggacgccaccgcgtccgcccatccctgtccgcaactgccgctgaccctgctccccgacggcggccccgtcctgcccggcgagtccaaccgcaccggcagcaccacagaggactgcctgtacctcaatgtgtggacgcccgcccgcaccatggtccggcccctcccggtgctggtgtggctgcacggcggcggcaacgcctacggcgcgggcagcgactacgacggctcggcgcttgctgcgcgcggtgtggtcgtggtgaccgttaactaccgcctcggagcactggggttcctcgcccactccgccctgtcggccgagagtgcggaccgtgcctccggcgactacgccctgatggaccagcaggccgcattgcgctgggtacggcgcaacatcggcgccttcggcggcgaccgcagccgggtgacgctcggcggtcagtccgccggatcgtcggacgcctgcgtccacatcgcctcgccgaccgcgaagggcctgttccaccgggcgatccagcagagcggaagctgcgcagcggacggcggactgacaccgcccacgctcgacgctgcagagcggaagggaagcgacttcgcggccacggtcggctgcaccgacccggcgaccgcggcggcctgtctgcgagccgtacccaccaccgagctcatccgcagcacaggaaccggggccgcgtccttgtggggcccgaacaccgggccccacatccttccgcgcacgccgcacgcggcgtgggccgagggacgggtgaacgcggtgccgacgctgagcggcaacacccacgacgagtaccgctacttcaccgccctgtacgtggatctgctcggcggcggcccgctgacccctgcctcgtacgcggcactgatcacgcttcagcacggcgaccgtgcggccgcggtcctcggcacgtacccggctgcggcgtacccgtcgcccaacctggcctattccaccgtcggcaccgaccagcggttcgcctgcccggcacgggccgacagccggctgtacagcagccgagcgcccgtgtacgcctacgagttcgccgactcccaggcaccaccgttcattcccgccccgcacacaccgcagggcgctttccacgcctccgaactcgcctttctcttccccacggacgcggtgccacccctgacgccggcccagcgccgtctgtccgccatgatgaccgcctactgggcccgcttcgcggccaccggcgaccccaacgtgccctgggctcccacctggccgcgctacacggccgacggagaccgcatccaagtgctgacgccggaccggacgggccccaccaccgggttcgcggccgaccatcactgcacattctggcagccccccactccccgggggcggtgcggtgacgtcgacgtgggccctggtccgggacgggtgccggagcgtgcggcagggcccctgacgccctggccaaccgtcagcgggagcgtttggtcgcgacggtcgccttcgcccgcgctcactccccgtactaccgcgagctgtaccggaccctgccggaacgcgtcgaggacccggccctgctgccggtcacgcgcaaagagatactgatggcccgattcgacgactgggttaccgacccggaggtgacgctcgaccgcgtacgtgccttcgtcgccgaccccggccgggtcggcgagcgcttcctgtacaggtacctggtcaccaccacgtccggaaccaccggacaccgcggcgtgttccttctcgacgaccgggcggcggcggtggccagggccctatcgctgcgggccgcccggcgcactttgaccgcctcggcgacggcccgtttactcgcccaccgcgagcggtcggcgcacatcgtcgccaccagcggccatctggccgcctgcacgcccggggcagccgggtgctgtcggcgcacagcccgctgcccgacctggtggaccaactcaaccggtaccggcccgtgttcctgagcggctacgccacggtgatctcgctgctcgccggtgagcagctggccggccgcctgcgcatcgctccggccgtggtgcccctggtggctgagggccccggtgaccgcgaccaccgccggatccgctctgccttccgggcgcctgtggtcaacacctacggctgcaacgagagcctcgccctggcctacggctgcgcgttcggatggctccacgtccacagtgactggctgatcctggaacccgtcgacgccgaccaccgccccacttcgccgggggagtccttcaccgtgctcctgaccagcctgtgccaatgggcgcagccgatcctgcgctacgacctcggcgacagggtctgctgcgcccggacgcgtgcgcgtgcggagacccgctcccctccatcaaggtccgtggccgcgtggccgacctgctgtccttcccgcgccggggcggcggcaccgtccggatcgtgcccatggccttcgagaccctcctggaaagcatcccggacatcgacctgttccagatcgtccagacgtcgcccaccaccctccgggtgaggatccggtccaccaccggagccgatcgagaacggctgtggacggcggtgcgccaggagctggccgccctcctcggcgcccacggggcggaccaggtcagtgtcgaacgggcccacgagccacccgagcagtcgccgggcggcaagtaccgtgtcgtcatgccccattcgtgacgccgcgcgacggggcgtcctcacccggggcgtcccgtaccggaacgccgtggtgagcggccagtgccagcaacgccacacgcaacgacccggtctccagggcggtgcccggatcgaaccagagggccacggctgttccgctcgccatcctgagcgtgaagcgcgccaactcgtccgccacctccgggcggtcacgcaacccgaagacggcgctcaccgattcccgtgcccagaccaccagcgcgtcgcggtactgacgcacctcggccacggccgccgcactggcatcctgctgcaccatgcccagccccagcagcaaccgcagaccgtgcggatgacgctcgaacgcgtccctgacctcggccaggaaggtgtccaggcgctggatgacgtcggcgcccggcacctcggccggaggcagggcagccagcagctcggtcctggcgcgctccagcaccgcgatataaatcccgtccttgctcccgaagtgccagtagagggagctggtcggcagaccgcacgcggcggagatcatcgagatggaggtggcggcgtagccgtaccgcgccatcagttcgccggcggtgtcgagaatcgcgtcccgggaccgtgcgccgcggttctggaccggtgcctccgtcataccgctgactttagacgacacgatggccaacgggcccatgcgtggattcagccataatcgcttgcattcggagccgcgctgatcggctctgtagcgggtccgcaaaagggttcggaacgtctctggaacagccggtccgcggtgacctgcgtactcagcgagctggtgaggtcggaccgggacgcccggccgacgttgccatcggcgggtttgcccagcccgcatcccgaaccggacgtgcccgatctccaggcatctccacaagcccctctcagacggccgccgcccatggtcccgctgggccagggcgaggggatcttgttttcgcgatacaagtagcgatcggcccggaccttcgcgcgcctgaacaagaccacctcatcgtcggcaggccaccaccggcccgcacaatagcgacggcgcggactcttccagctggaccaacagtgcagcttggtccgcatctcccgtacccggcgctcggccttgagcagcgcgcaccccagcgcatcggcattcaccagcggcctcccggcattgcagcatcctccctgccgacttaccggcccccttcgccatgcacggagctttcctcagctcggactactacggaacctccgccccgcctgcggacctcagccggcaacgggcctgccctcggtctccggatcggacgcccggaaatgagcgcgaccgcaggcggttcccgcgttcaccacgtgccgatcggtcaggtcggcgtcccgcaaaacggtgcgactcgatctttccgtgcagcagggagagtgcgtaccagccctgagcgaggacggtgagcgcgccgggtctggcggtcatgggcgagcgcgcctgcaagtacgcggctccgtccacgcaaccaactccgcctcactgctactcggtatcacccagttcgagaaggactgccaaggcttccgctgaccgctcagcaggcttgatcagtcggccttgcgtgcgcggactccgcgggctggcgggtgtggcggaagaccgcagtgcctgcgcgacagcgtcaacgggcctgtccagtgtggtctttcgcctggtagggatcgaccgacggcgccgtccgtgcgtgtcgcgctgtcagcagcgtagtggctgttcggcccagatggttttgccgcgttcgccgtaccgggttccccagctccgggtcagctgggttatgaggtagagaccgcgtccgccctcgtccgtgtcctgggcccgtctgacgtggggagatgtgctgctgccgtccgacacctcgcagatcacgttgcggtcgaggatcagccgtagcgtgatcggttcttcgccgtagcggatcgcgttcgtcaccagctcgctgacgatcagctcggtggtgaacgactcctcctccagcccccaccgggccatctgctgcgtcgtcaggtcgcgtgcccggccgaccagttcgtcctgagcctctatcttccaggtgacatggcggtccgaagccaggccgctgacccgggccgtcagaacggccacgtcgtccttgtggcatgtcggcagcagttcgcggaccagcgtgtcgcacacctcttgaggcgtggcggatggaggagtccgcgaaagggtgtcgcgcatgcggtgcagtccggcatcgagatcctgggcgcgcggctgcagcaggccgttggtgtacagcaccagaacgtccccgtcgtccatggcgatctcacgcttttcgaacacgatacctcccaggcccagtggggggccgccaggcagttccacgaagtcgacggcgccgttcaccgagagcacagccggcggtggatgaccggcgcgtgccaggagacagcggcgggacacggggtcgtacaccgcgtacaggcacgtcgctcctgtcgccaggggcccttcgtcactccgttcgtcgaggaagcggttcatctggtcgtcgagatgggtgagaagctcgtcgggggccagatcgagatccgcgagcgtacgtacggcgctgcgcaggcggcccatggtcacagcggactgcaggtcgtgtccggtcacgtcgcccaccacgagcgccactcgtgcgccggacagagggatgacgtcgaaccagtcgccgcccagcccggtgtgcccgctcgcgggcaggtagcaggacgccgtccgcaccgccgacgccgacggcagccgctgaggaaggagactgcgctggagggtcagcgcggtcgtccgctcgcggtggtatcggctggcgttgtcgacgcacaccgccgctctggtcacgatctcctccgccagcagcacgtcgtcgggctcgaaccggcgggggttgccggagcgcaggaagacgacagcgcccaggacgacgccgcgggcgaacatcgggacgagcagccacgaatggatcttcggtccgtcgtccggggagtggcggaggccgactgcggcggggcagttctggagttgatcgtccgccaggaggacggattcacccttcgtgagagcgtcgaggaacggcgagccgggcgccgtcgcccacaaattggcatcccccaccttcacttccccggcagcgtctgaccccgtgtcttcggctgccccactgcaagcggccctgcggaacagcgggggacgcggtggtcggccttcggtcggttcgcggccggggaagactgagtccaacaggtcgacaaagcagatgtcggcgaagcgcggtaccgcgacctcggccagttcccgggcggtgcgccaaaggtccagggtggtgccgatcccgatggccgcctcgttcgtcaggaccagccgctcgcgcgatcggacccgttgggtcacgtcggagacgacatgacccaacgcgatcaccctcccggacgggtccctcaggggcaggatggactccgaccacacgtactcccgcggcgagttggccacggggtggccgaccacctcggtgtcgatgagcgccttgccggtctcaaggacccgccgctggcgggcttcgagggcatcgacgtccagcaggccgggcggcgccatctcgcgcatggtgtgcccggagtactcggtcccctggaacacgccggcgcgccgctcggcgatgttcaggccgacgaagcgcagctgcgtgtcgaagatgtcgatgttgaacggcgagtcggtgaacagccccttcagcagggcgcgcccgtattcgtacgtgcggagtacggcggtacgggccgcctgcaccagccactgcggatcaccgttcgcggacgtgagggcacggacccagatctgggccgccagcggcttcccgctgcgctgtcgcaggaccagagacccccggcgggcgcccttctcccagcgcctgacgatgtccgccgcgtcggcggggtcgtagaggaactcgtccgcactacggcccacagcctcgcgcgccggacagccgagcatctgctgcgctcccggaccccaggccgcgacccgaccgcaggcgtccagcaggacgtccgcctcgcttcccggttccggaaattcaccgtcgccgcgaaaggtgatgtcatgcattccgcacctcgagcacatccgtgcaggaatgtggatttgagcggcttagtccaatttagcaatagatgatacccgtgacgtggtcatctttctcgtcactccacggcctgggcggtcttctgccgtaatcaccgagtcttgggcgatctgatccgggcgccccgcgtggccaggctccggatctgcggcagccgggacggatgtcagcggacgggtaatcctggcagcgccgcgccgcaccatagtcaccatcgccagcatcagctctcgcgtctcgcgcaaatcttgcccttgatcgttgccgcccggccccgaccctgcgaaggtttcggccactcccccaaacccccaggtcatcggaggccccttggctgcccgtcgtgccgttgtcgctgccgcgtcagcggcactcgtcgtcccgctccgcggaggcgcggccgccagcggctgcggggccgccgcgccccggcgattggctgcgtgccctttacaccgggcaaccaagtggccagccgtcgccaccccgtccggtgctacgtgcaccaccttcacagcatctgccgtagccgacgtaccggaagcaccccgtactcgcaccctttgccctgtaacggagcggcggctggtcagaagatgaccacgtggccggtgcgcggcgcggtccggcccgactggacctcgcgccagacctgcgtcagggcctgcgggccctggccatggacgacgtcgacccatccctcggccacgggggcgaaccgctgccatgcgtcggcgaaccgccggtccagccctgcgcgcccccactcgccggtgcgcttgcgcatctggtcgggggcaaagaacatgcccggaccggtttcggccagtgtgccggccggcccgggctcctggttggtgataccgacgaccacgtggtgcaccagggcgtcgcccagatgggcgctcagcgaggcggtcagccgctcgtcgccggcgaagtctgcgtacagagtgggccggttgggcagttgcacgacgtcctcataggcgagcacccggtcgtaacagcccaagctttcagtgaaggctacgttgcgccgggaagtaaggccgacgatctcgcacccccggccctgcagcaggaaggcggcaccgtaggccgtcttgctcgacgctgacgacaggacggccgtcgcagcccccagccaggcattgtcgacgagccagtcggccagcatgaacgaggtccagaacagcgggcggtacaggatctggaggtcctcgcggtcggcctcgtaggcgagatcacccgtggtgagggcgtacgcattgtagggccggggcagtgtctgccggtgggggctcgcgtcccggaagccgcgctcgtccacccggccggggcggaccaacaggtggctcgcggacggcagatagccgtagtagcggctgcccggctcgatgccctccacacgcgagtcgacgacctctgcaaagccccacagggggacgatcccccagccctcgcgggaagcggggaagaactgccagtagcggaaggagtcgccgagcgcggcgtaggtgacgttgttcgcggtgaggccgacctggtcgacccgaagcagcgcctcgccgtcacgaacctcgggaaccggtgcgtcggcgagttcggcgatcgacagatcgtcgcgggcgatcagcaggttccagccgacggcagcggcggtagcagtagtggtggtggtgtccatggcccggaacgtacttgaatccgaattcggattcaatagtgggcctagaatgcgcgcatgccctccccccagcacgaacgtgcccccaccccgccgcgcccgcggcgagcccacggcgcacccggcgcggtgtccgcacccgcgacgccctggtggccgcagcgcggcggatcttcgaacgggacggctatcttgaggcccgcatcgtcgacatcgcggccgaggccggggtcgccgccggcagcttctacacacacttcaccggtagcggcggtgctcgggcagcgcgttcatcagcacgcgataccgcggtgcaggatcaaggacagcagggccgcgcggcgggtgcggggcgggctgaagcgctcgcgaaaggcttccggcaggtctgcgatggtcagcgcaccgatcacgtgggcggccaccgtgcgcacaagcggccaggccggcttcaggtggccgaggcggcggggtgcgggagcttcacggagcatgtcgaagagcaggtagcgcacgggttcgctgtattcgaggcgctcgcggatcgtgcggtccatatacgcgggtacgtcagcggccgtgaccgggaacaggtcgtcggacaggccgaactcggtacacaccgcacggaattctccgtatatctgatccagttcaggcggcgccagcgggcgtcccgacagttctcgcatcgccgtcatgcactcgtacaaggtgaccagcacccacacccgcaccgccgggtccaacgctgtgaatggcctgccctgctcgtcggtccctgccagacggcggtgcgtgcgctccagacgggcgacctcacggcgtagcccttcacggtcggagaagaacagccgcttcccgctgtccatcgtgtgctcgctacgccgccacgggtgcgcgcggtaggtggagaagttgtcatgccggcggcgaccgccggatctgcagtctgcagaaccagcagccgccacgccaccaacccgatccgccactcccccagcgtgcggcgtagcagcgaatcaggaccaggaagatcagcggtagccaaggggacgtctcctcaagtacgtgcacaggaatgagcaggggacgaccggaagagggatcatccggctatccgcccagcccaacggccctactggaatccgggagcggccaggttcccgagttcaaccatccgggaagcgcctcagggctctgctgagcgaacacgacacggtggatggaggggtggatggcagcgaggaccaggcgccagagctcggccggccccgtactcggagcaggcctcccccctcggctatcgcgcgggaagaggtgtcctcctcgccgggaggcttacccgcgggagatgactggcaacaacgggcggcgtccgagcggtcgcgggcgtattggatcttgttggtgagcaggaccgcggagtgcccgcattgcgaggagatccacatgccggtgctggtgaagccgtagtgcagccagacgtcctggtcggagccggtgccgggtgccagaacagaccgcgggccggtgccgtcaccggtccggacggccaaggacacctccgcccaggccgggccgaagccgggccgggcaggtgcggtcgcgggggcgagcaggcaggacctcatcctgcgcggcggccaagacgtctaccccaccgagatcgaacacgtccggcgcaccctcgaatgggtcaccgacgccgccatcgttcccgccccctgcgaaagccgagcgacgccaggaggtccacagcagcctgccgcccatccacaccaggtaggcggccccgccccagcggagtgcctcgtacgcgaagtgagaggcagtcagcagagcggtcacaccgaccgaggtgagcactccccagaccagcgtgccgctctggatgccgaggaccacgccccaggcgcgacggcggtgcgcaggacgagcgcggtgtccagtccgggagtgacggtgagcagtcccaccatcagggagaaggtccacaaggcatccatggcgatcacgaacgatcaccctaggccgggcgtcacgcaacctctactcttctgcccggaatcgggcaagagttgcagcaatctctgatctacgaccgcgggccacacctcagaacggtgaacccggaaaatcctcaaaccagccgtggcgccccagccaacggtgcacgccacctgccactcgccccgtccaacgtcgtgatcacgacacggccaggtccgcgcatgcctgcctggcggtcgtgcgcgcccgcgacctggacgcgggcaaggtggaaacgcgtgggggcggcaggcgaaaggagaggcccgaagcctcctcgctgggttgggaagagaggcggttcggcctctgcggaggccgtattgcccgcactgccccgtacccttcgtggtgtctacggcgtcacttagcgggcgccaaaccactggaggcaacaccccgtgctgattgctcagcgtccgtccctgaccgaagaggtcgtcgacgagttccgctcccggttcgtgatcgagccgctggagccgggcttcggctacaccctcggcaactccctccgccggaccctcctgtcctcgatcccgggtgcggcggtcacgtccatccgcgtcgacggcgttctgcacgagttcaccaccgtgccgggtgtcaaggaggacgtcaccgacctgatcctcaacatcaagcagctggtcgtctcctcggagcacgacgagccggtcgtgatgtacctgcgcaagcagggtccgggtctggtcaccgccgccgacatcgcgcccccggccggtgtcgaggtgcacaaccccgacctcgtcctcgccacgctcaacggcaagggcaagctggagatggagctgaccgtcgagcgcggtcgcggctacgtctccgccgttcagaacaagcaggtcggtcaggagatcgggcgcatcccggtcgactcgatctactcgccggtgctgaaggtcacgtacaaggtcgaggcgacccgtgtcgagcagcgcaccgacttcgacaagctgatcgtcgacgtcgagaccaagcaggccatgcgtccccgtgacgccatggcgtcggccggcaagacgctggtcgagctgttcggtctcgcccgcgagctcaacatcgacgccgagggcatcgacatgggcccgtccccggtggacgccgccctcgccgccgacctggtgatgccgatcgaggagctggagctcacggtccggtcgtacaactgcctcaagcgcgagggcgtccactccgtgggtgagctcgtcgcccgctccgaggccgacctcctggacatccgcaacttcggtgcgaagtccatcgacgaggtcaaggcgaagctggccggcatgggcctgggcctcaaggacagcccgcccggattcgacccgaccgccgccgcactcggtgcggacgacgacgcggacgcgggtttcctggagacggagcattactgaacgctgcgctgcgctggtcatagagacacgtcgcgacggggacagcacccgtagctccttgagtgacggtgccgctgttcctgccggcagcacgtaggactccacctgcagatctgcgggatcttcggctctcgccagggatggcgctgccgcggacaggaggcgacagtcgtcatcatcgtcagtacccgtctgcgggcacagcggagcaaggccgaagacgtgctgtttcccgggatcgacgtgcggttggagggcgtggtggtcaccggtacgctgctgttcgtcgatgccgcagcgtgcgggcgaccaccgtactgcccgaactgccggtggcgggggcgcagaatccactcgccctaccaccgcagcttgtccgaacgccccctggctggccagaagtcggtcgtgcgcctgcgggtgcggcgcttcttctgcgaccggaagtcgtgcgcccgcaggaccttcgtcaagcaggtcgaccggctgacggaacgccaccgccgctccagcctcgggctgaaggaatggctgacgacggtagccgtcgagctcggcggccggcctggggaacgggtttgccgcaagctgaacctggcggcgggtcggacccacctggtggggctgctggaggagccgccggtgccaggcccgcgctctgctggacgagcacaccgctgtgcgcggcccggggaccggctgggacctgcaccgccacactccgtcctcaccccctcggcgagcagggtgcctccctgctggtacttgtttcccatcctctgatgcggctcggtggacggcctagccttgtgggggggttgtctggctctggaccggaattggggtctgacaccagtgatgcgggccgtgtcccgtcacggctggggagccgtgaccggcccgtttggtgtgtgaaacacatgctcgaaggtgctacggcaacgctctcgcctgtagacagatggccgggcgcggggcgccgatcaggtgaactgacacccgggtccaggaagccggaggcggtttcccgagctgcggactcatgatggccgtatgccttccgctgggcgcgtccgacgacatgccgggcaggcagtcgacaccagacctatccgcatgcagaacggcaggcaacggcccccggccgacagggccgtggggccacccgtccgagtgacattccatcgaataggcgtattggtccagccatactggcgccgttcgatgccaaccggtcacggtagtgcccgggcgctcgcgggcggccgagcaccgaaaggagtcccctcatggcagacgtcaaagtcgggctgtacgtatctctccaggccaagcccggcaaggaggaagacgtcgctgactttctccgcaagggccttgacctcgtgcaggaggagcccggcaccgtcgcctggttcgccgtgcgcctgaacgcgaccgccttcgcgatcttcgacgccttccccgacgtctccggacgccaggcccacctcgcaggccggctggccgcggccctgatggaacgagcccccgatctgctcgcccagccgccttccatcgagcaactcgacattctcgcccacaaactgccctgaaaccgaaggcggctggtcggcccggcgtggccgcctctgtccccgatgctcgcactctctgaccaaacagctggagcacacccaccaagatcgccacgcataagaccacccgccggcccgccctcgccgtgttcaacgaccgtctgcacctggtccaccgcgggcaggccaacgacagcctgtgggagtcggtctacgacggcagcagctggaccaccgacactcccatccccggccggcacagctggcgcggacccgccctcgccacctaccgaggcgccctccactgtctcgccaccggataacaccaccgccccggcggcccgccacccaggtggcccgccccgccggacgagcgagcagcgggggcctccaccaggacaagacctgcggacgagctggcacgggtcaggagctgtgtcatatctggttgaggcacagccagccgaactcggtggttcagcgggggcgggactgatgagcttgatcaggcgtcatccgtaactcaagatgtctgcgttcaactcggcagcgcctacaccgacagcacaggagacaatgaccgacccgacggtccccgctggaccgaagagagtggttgcggccatagtgacgccggtttcagatgctgcgccgatacctgccaggcagccagcgaaatccccgacaatacggctgcctatgtcaagaaaatccgagaagctgaacagtccgctcgggtcgatgcggttgactgggccgtcttcggcgtagaggtgggggttcccctcttgtccggaggggtcggggctgttgaagcggccgacgttggggtcgtggtagcgggcgccggggtggtagaggctcgtgggatcctggtaattgccggtgaagcggtagggctggcagcaccccgggatgtagccgaggtccaggtcgcccgaggcccacgagacagtgcacccagtcggcgaaccatggccgacgcctcgccgtagcggtcgacgtggtcgaacaccgactggcggtcgtgggcggcagacgagccacttgcttctgccctcaattccttgcaggacaaccctattcgacccctgtctcgcatttcggattccctcaggcgaaccggtctccggccatccgcatcgtcgggatcagtacggcgcgcgaaatcggatccgaatcaccgcgttaggagcgattcttccgacgagccaagaaggcgaagcccgccaaaacaactccgctgactgcggcgatcactcccagtacgagcggaacagcatcgtcagtagccgttcctgcgacgcacgcgcatattcctcctacgatcaagaccgcagagaagattcgcactcctctgattgcgtcatccatcgatgcacccttccgccgcactcgtaggagaaccgttgggccgagaatgagttcccgacccaacagccatctagagaggccgtagcctcctgttcaatctattcttcacgtattacccgtaggtgagaatctccgctccatagaagcctgcggcacctccaagcgcgcagctgccgactacggcgagaccaacgcctacagcactgccaactccggcgcccaccacgccgccgacggcggcggcgtatgcgatggatccggtctctgctgcagctgtaactcccgcgaggcagccagtaacgactccgaaaatgtcgctgcccgtgtcgagtgcgtcggagaagctgaacagcccgttggggtcgatgcggttgacggggtcgccttcggcgtagaggtaggggttctcctcctgtccggaggggtcggggctgttgaagcggccgatgttggggtcgtagtagcgggcgccgtagtggtagaggcccgtgacgtcttggtagccgccggcgaagcggtagggctgggggttcttctcgctggtggaggccctggtgacgccgcgggggctgtaggcgtaggtgttgaccttggcgcctgtctcgtcggtgagggcgatgacggagccgagtgcgtcggtgaggtagcagtacgccttgcccccggtcgtcatggagttcagggtgcccccgggttcgcggttgaatcccgtgtccacaccggcagttgaggtgccggccaggccgatcggcccgttgtggaagtaggtgtctccgaggcggatgcgttcgctctggtcggtggaaccgtactgcccggtgtatgtctttccgcccacggtcagcgacgtcagctgggagtggtcggtccacttctcggccgtgcgggtgccctccggagtcgacgcgccggcggtctcgttgccgatcttgtcgtaggaccagttcgtcgtggagccgttcttcgcggtcagctgctgggcgtcgttgacggtgtaggtggtggcgccggggcagccggccgcagtgccctggctggtgaggttgccggcgaggtcgtagcagtagagccaggaggagttgagggtggtgcccttcttctcctcggcgtacgagaagcggcccgcgccgtcgtaggtgtaggtcgtcttcaggccggtgacgttgtcggtggacgagcggatcttgctgccttccgtcgtcccgctggtgccgtatccgtaggagtaggccaggtcgaccggggtgcccttgggggaggtggtcttgatggtcttggggcggctggagttgtcgggatcgaccttctgcaccgtgccacccggataggtggtcgtggtacggacgtcgttgttgttgtacttgtacgtcgtcacccggcccgcggggtccttcagctcggcgagcttgttgacctcgttccaggtgtagtcgaccgtgccggccgggtcctggtagtagtcgacgttcccggacggggtgtacgcgagcagggtctgcgagccgtcctgcagggtgcggatcgtctcgcgttgcagcgggtcgaagtcgtacttgatggtgccggtgctgtcggtgcgctgggtgaggttgccgtcgccgtcgtaccagtactcgacacgtgccttgttggtcgtgtcgacgatgcgggtgcgatcgcggttgtcgtaggtataggtgacggtcacaccgcgggcgtcggtgacggtcttggtgcggcccagcgcgtcgtaggtgtaggtgatcttggccagcggggcgggcggagtgacggtgtccaggttgcccgcgctgtcgtagtggaaagtggtggtgaccgtcttcgccgcggtcatcttcgtcttctcggtgcagcgctggcctgcgaagccgccgcacgtcggggaggcggggttgtaggtgtaggagacgttgccgccgccggtaccggtctgtgccaccgacatcgtgttgccgaccgcgtcgtaggtgaagtccgtcttttcaccgtcggggttggtggagtccttggggacgtctgcgccggcgatggtctgccagtggttgaccgtcttgccgcccgttggctgagtgatggtctcgaggttgttacgggtgttgaagccgtagtcggtgacgttgcccggtgtggtgcccgagcccatcgcatccgtgctggtgtcgatgctgtggttcgcgtcgaacttggtcgagcgcttgtggcccatcgcgtcggtgacgtcggagacctgaccgtcgctgtcgtgctggtacttcgtcgcgtgcgtctccgggtcggtggccgtggtcgtaccggccgcggtcacagagtcgctggtgtaggcgtaggtccaggtcgggccggtgtggccgtcgctgttgaagccggtgccgcgcagcatggaggtgacgcggttggcgtcgtcgtaggtgaagaccgtgacacggccctcggcggtggtgatcttgtcgacgcggccccaggcgtcgtagcggaagacggtcgtcttgccctcggtgtcggtggtggaggccaggttgccgttcgcgtcaggtggaagacggcggtgcggccggtgttgtccttggcctgccactgcgaggcgtccgtcttggccaggtccacccagcggcccgaacgggtctcggtgagcttgaagcccttgttctcgccgctctcgtcgtgctgagtgacggtgaccgagcccttgttgcgatcggtgaccttcgtcagcgtcccgttggcgtcgtaggtgtccttggagtgggacttccagttcgtcagcgtgtaggtgccgtcactgttcttcttcagctcctgcgaataccacttcggggtggtgaacgtaccgtcactccaggtcgggaagctggaaggagtaccggccgagcacgttgatgtggtggcgcatgaacggggagagccgggcgacgtcctcgtcgcgcacctcgaagccgtcggcgcggagctgggtgagggcggcgtccatgtagcgggtgttgaacagcacgagcgcgttgaggaccaggccgagcgccccgatctggtcctccatgccgtcctggtagcgctggtagagctgccccgcccgccgggcgagcgcgtggtggccttcctggaggttggcctgcaccttgatctgccgccggtagccgggctcgtcggcacggtcaggcgcaggatgtgcagagtcttcgcgatccgccgtagtacgtgatcgcgtcgccgagcggggtgggccggccatcgcgggagagcatccggatgacgtcgtaggcgcggacggctccgaggcttccaggctctcgtcggcgccccgggctaggaggagccatgaccggcgaggtcggcgccatcatcgagtagacggaaccggccgtactcacggcggccgccgtcacactggtcgaggggccggcgttctgcgtatcgggcacctcttgaccgcgtaggttcgccgggttggtggtcgtggcggttggatgtgcactgacgtccgtcccgaccgctgggggtgtggtggccgagcctgtctgcgtgcgcaggttgaccgatcaggagggtcagaagctgcagcagatcgtgcgccggggcagcgccagttcggtgcggttccggcgggcgatgatgctgctggcctcggccggcgggaaccgggtgccggtgatcgcccagctggtgtaggccgacgaggacaccgtcagggatgtgatccacgcgttcaatgagaagggcctggcctgccttggaccctaattcgttgatagcagcaccggcgcgtgactaggagcgttgccggactgttcgagtacgggactgtgacgccttcctggaccccggccgatgaggcctccactgagaggggcggcagtcccatgactcgggtgttggcagccgtgtgggcgtcgggcggacaagctatacaagccccggcccgcgaggcctcctaggtagagcggtgacgcctgacgtcgtcacggtcgccaccacaggagtgaacctccgctctttggagttggaggtgcgagcccgtttcacggcgacctcttgccagccctgaaccaccgagttctgggcaagaccgaggcccgtgaggcgcgctggtgccgcgaacggcttgtgagatgtcggacggaagagtcctggaattagggagccgcgcggcccgcattcgctcgtgcctagcgcatatgtcagcgccaaggggaggaaacaccgtgatcagacccgggccctccacgcctgtctccgctggcgcaacgccaacgcccgccaccccgacgtctgccgcccagcgtcgagagtgcgcccgcagccgcagtgagaagggcatccgatggggcggacgagcgaggacggcggcttgatcattcgctgacgttcaacgtcgcgcagtccccgactccagttcggacagcaccgcccggagccgctccagggccgcggtcgtgtccggctctccgcgatttcaaggtcaagatggcagcgacccatgccgctgcccgcgccggtgacctcagcgccgagctcgaacgccgtctccagagcctcctcgacgtcgtcacgatcgatcggcagccccacgaagacgatctcgactaacactccggtcctccctctaaacccggcgaaccacagcggtcagagcacctagctgctcgccggtcgaccgttcgccggcgtctcggttcgccagccgaggaggatcgtgtgaagcgcctgttcggcgaggtagcgggcgcgatcgttgccgacgctgccgaggtaactgagcgacgcgatgccgtacagcgtgccccagaggatctcacaagcctggtcgaaatcggccaggaccacgtcgtgcgcagccgaccaggaggtgagcagctccttgaggacgtcgatgaccggttccgcgacgcgccgacgttcgtccgcgtcgaccatcgggtcgttcatgacctggaagaggtgggggtgctcgccggcgaaccggacgtactgcgacgcaatgcgcgtcatacgccggtccgtatcgggctcctgcgcggcttggctgaactcgctcagcatcaggcggtgaccgtgcgcgaccagctccagtacgagcgcgtccttgttggcgaagtgctggtagacgacgggcgcggaatattcgacgtcggtggcgatgcgccggatcgtcagggccgcgatgccctcggtctcgaggacgtgcagcgcggcctcgatgatccgctcccgggtgttcgcccgttcgcgggcccgtctcgtgctggtcggcatggtccgtcacttcgcttcgatggtgttctcgaacactagtcaccgccttgaccgcgtcggcgacgcgcgtcatagttaacgccgttaggaaatctaacgacgttaggaacgagtagtaagtcatgatttaccacatcaacagagtcacgatgaaggccactgcgacgcctgagcagatcgaaggggtgctggagagctggcgcaatcagggccggtcgaaccccgccatcaagtccttcgtggtcggccgcaaccacggcggcgactacacgtacggcgcggtgttcgtcgtcgaacatctcgacgggctcttcgcctacctgacgcacccgaccacctaccagaccgaccacctcgggctgcacctggtcgaacggctggagatcttcgacgtcagtgacgacgacgaccctgacctgaacgccaagatccaggaactgcaccggcgccgcaacgagctcaacccgcagatcgccggcatgctcgcggacgtgcccacctacaccggctccggcgtggacgactgaccgatcccccggagaaggagaaaccgtcatggccaagcacgtcatcatcggtgccggttccatcggtaccaacgtcgctcgtctgctcgccgagggcggcgagagcgtccggatcgtcacccgcagcggctccggccccgagcacccgctggtcgaccgggtcgccgcggacgcatccgacccctcccgcctgaccgagctgtcccgcggcgcgggagtgatctaccactgcgccaatccaccctcatacacggtgtgggagcgcctgttgccgcccctgcagacggcggccatcaccgccgccaaggcgaacgacgccgtcctcgcgctgaccggcagcctttacgcctacggtccgcagcccggcggccggatgaacgaacacacccccatggccgccaccgggcacaagggccgcctgcgcagacgcatgtgggaacaggccctcgccggggggatccgcaccgtcgaggtccgcggctccgactacatcggcaaggacgccaacggcatctactccctgctcatcaagtcggccctgcagaagggaaaagcggcctggatcaccggccacctggacatgccgcacaccttcaccttcaacggcgacatggcacaggccctcatcacgctggcctcggaagaacgcgcgtggggccgaccctggcacgtgccgtccgcgccggccgtcaccattcgcgagctggcgcggcgctacgccgtcgcggcaggccggccaccgatcaaactaatccagataccgcgctccgtgacgcgtacggccgggctgatcgtgccgatcgcccgcgagatggccgagatggactaccagtggtatgcgccgttccacatggacgcgacggagaccaccgagaccttcggcctgaccgccaccgacctcgacaccgccgtccgcaacgaggtcggctgaactcccaccgccccaccggcaggccgacggcatggccgccgacaccgtgcacgttcgtggtcacggcactagccagctactgactggcgagcgaggggtttcaggcggtggtgcggttgccttggcgtgcggcgagcgcggcgtcggcgctggagtaggcgggcaggaaggcgtccatcccggtgacgctgagcaggcggctcagccggtcggggatggccgccagggtcagggagccgtcggcgtccttggcgcagcgccagatgccgacgagggcgcccagtcctgaggagtcgcagaaggtgacgcctgagaggtcggcgaccaggtcagggtggccgttcgcgatgagttccagggcgcgggcccgtacggcgggtgcggcggcgatgtcgaactcgccggacagggcgatcacggccagggcagcgtcggtgtgcgggacgtcgatgtggaatgcgtcggtcatgggcgtgggttctcctgcccgacggagacgtcggcggtcggggcggcggcgctgtgggcggtggtggtgatgccgacgggagcagcatcgggggtggggacggacagggccagcagggccacgtcgtttcgccgaggtgttcgcggtcaaggagagccgcgtacgcgtggtgggcgagatcgcggccacgcccaccggcgaggctctggaactcgtgttgcacttgggtgaatccctgcgcggcgtgcgggtggagagcagcgatgccaccgcgcggccggacgggctggatttcctggccgagcttccggcgcgcggcgaatggcacaccaccgccctggtccgccccagcgtcgagggcgaggaggccggcggcctcttccacccgggggcggagcccggcgagtccgggccggcgcgccgcctgtgtgcctggcgcgagagcgccccgcgcatcaccgacatcgaggacccggaagtgcacaggacgctgcggcggagcctggaggacctgggcgcccctgcgcatcttcgacccgcggcaccccgaacacacggcggtcgccgccggtgccccctggttcatggccctgttcggccgcgactcgctgctgtcctcgtacatggcactgccgctggaccctgcacaccacggtgaacgcaggcgtcaagctgtggatgctcgtggtcaccgccgtccgtgcgcgggcgcgggccgggtcggcgtggcaggcttgcaggggggcgcgccgttcgtcgcaacacagcagcgaaggggtacgccgcatggatgagaaggaattcctccgtaccgtcgccgagcgcaccggactgagccggcaggaggcggcggacctgacctgggccacactcgagacgctggcccgccgactgagcccgggggaagccagggacctgatcaccgagctccccgagggcctcgcggaggcggtgcgccggggaaccacggaccgcatcgagcgcttcggccaccacgacagcgtgcggcgcgtggccgaacgcaccatgctcaaggaggaggaagccgaccggggtgtgcggaccgtactggccgtgctccgggaggcgatcagcgagaaggagttcaacgacctgatgtcgcagctcggaactgacttctcccaggccctcgaatccgccgggtgaccccggatccttcggcccgccgaccgcgccacggcggcagcggcccgcacgctgcgtgtgcgccggggacggacggcacggtgagtgacacccgcggaccgctggtacctcgcggccgccatggcgtgaggcgcacacgaaggtgtgatcatgacagctgacgtgcccgagacatcctccggcagatccgtgcgcgtcgcgctggtggccgaccccggcctgccgtcggagatcgcccgggctctcgccccccggttgcccgaccatctccgccgggcagtcggtgctcgggtcagatggcaggtcgacacgatgaccgccccgctcagcgtgagcgagcaggccgacgtctccgacatcgccgaggccgtcagaagccacctggacggtgccgaatgggacgtggcgatctttctcaccgactttccgcggcgggcccggctctacccgatcagcgtcgaggtcgacaccgcgctccgggccgcgctcatctcccttcccgcccttggggtccgccgccttcggcgccgggtgcggcaggccgtcgtggatgtcgttcgagagctggtcgcgcacgaggagacgcccaggcacccggaggtgatcggccgcccgccgcgcgaaccggtaccggacacccgtcccggccccgagcagccccagcgctacgtcgtgcccggcctgcgcggccacacccgactcgtcgccggcatggtgtacgccaaccgcccctggcggctgttcggctccctctcccgggccctggcgggcgtgttcgccacggctacggtgctgttcatcaacagcgccacctggaacctcgccaccgcactcggcgccgtgcagcatgccgtcatcaccgctgggtccgccgtcgcgctcaccctgtggatcatcgtcgaccaccagctctgggagcgcggcacccacctccccgcacggcaccatcccctgtacccctacaacctggtcaccctggtcaccatcgcgctcgcggtggtggtgctggccgcggcgctgttcgcgactctggtcgccgtctccttcctgctgctggacgcgtccgtcctgcgcaagttcatcggacggcaggtcggcgtcggcgactacctcttcctggcctggttcatcaccgccatcgcgatgatcggcggggccttcggcaccagcctcgaaggggacgagaaggtgtccgacgccgcctatggacgacggcagcgtgaacgtcagcggatgctgcggcagatgccgcggccggaacgaggcgaacgcagggggccggacaccaccgacgggtgacgcccgggccgcggccgggcgtcacagggcgatgacgtggaggtcgaccagctcgagcagcgcccgcagggccgagctgggccgccgggtcgacgacgtgccgagatgcatgctccagcggagcatggtgccgtggacgtccaggacgtccaggacgtgcagaccgggggtgcgcgcaccgcagcgtggttgcgcgtcattcgcagcggcacggcggcgggcggagttgccgagggccgaggtggccatgcttgccatgctgccgagtacgaatgcggggctgccgaaggcaacggcgttttggtgcatgtatctgccgtcgccgagggcccgccaggtcacacgttgtgcggggccgaccgcgagtactcgttctccggcctcgagccgggcgacggttgcgaccagcggccgctgctccagccgtccttcggccaggtcggcgatgatgtcgcacgaacaccacaggtactcgtcgagccaggaccaccccggccgttgctcgatgccggaggcaggagcataggggttcacgttctctccgttctctgcaggctgacgtgccatcaactgcgcgcgtgctatggccactttgctgaggcgcgtgtgccctcacgagggcgtccgaattgcggcagtgccggcagggttcgtgctgtcgaggcgtccgtggacggcgtcggtgtatcgctgtgcggtggtggggccgcagtccgaagaccgccgcgaggtggaggggtctcggacaccggtggcttcggcttcgtcgaggctgcggccctgtcgcaggcggctgagtgtggtccgctgtccgcgaagggcggtcccgagccaggccgtacggagccgattcaggcccggcaccacacgcttcctcggcgatgtgctcgtctatcaacgccaccgagacgctctccacgcccgcgtacgccatgtcatcgacgatgtgcatcccggcctcgggcgcggtgccgcccgcccggtgcgcatcgcgacccacagcctggggggtgtcatcgccgtcgacatggccaccgccaacgtgccgttgtggaccgagtccctggtcacgttcggctcccaggcgaccttcttccatcagcccgtgccgggcgacctgctatgccagatgattgcgttccgcatgcgcaagcaccaggaagcggaaacgggcgctcttcctccggagacagggttcatagcccatgccggtcaaggatggtgatcagtttgcgcctgcgtttcagctcggcccgcagatcggcgacatacgcggtgaactcatcctctgtacccagcgaccggtggcaagagcggacgtcgagcaacagcctcgccatctgctcgtagacgcggtccccggtgggtcccttcagcagctcgacgagccgcaggtacaccgcaagcgcgtctgccgggcgcgtctcgcgcgagaggtcggcgagctgctgccactgccggtcgtcggcacggtcggccgcctcccgccaagcggtgtccaggtcaccgtcgtcgaggagcgcgtcgatcagtacgggcccgcggtgccagccgccgcgctcctggcgagtgccctcgcgcagagcggccagcgccgccgcccgctcggtctcccaacagtccgcggcccgggcagcagcacgcagttgctggtaggcggcgagggatcgctcggccaggaggcggtctcgacggactgcgacggtctcggccttccggcctgtccgcgtgtagcgggcgcacacgtagtcgaccaggcgaccgtcgacgtgtgcctcgtcgacggtgtcccggagtccgcgttccgcccacgagagcgcgtcctcggggcggccggccgcacccagctcctcggcaatgcgcagatgcgtggcaccagagggcaccagatctttcatgtacagggcgaccagcgcgtccacgtcgccctccgccttggccaggcgctccatcaggtacttctccgcccagccccgtgggctgcgccgccgagcctcggccgccagctgccgcaggcgggccagcccggcctgccccaacacgtcggcgtagtcgagcggatcgaggtccgtcgcatcattccactcaccgagcacgtgaccgaccagccattcggccaggcgctccggatcggggcgagcgactccgcacgcttccaggtgggccccggccaccgcggcaatggcctgcccgactacgccgtccgagtcatcgatctcctcgtacgcctcgccgagcgcccggatcgcgtcctcggccaggccgaccgcgcgcgccgcctgtccgctggtggtcagggcacacagcgcgtccgccgtctccgccacctgcctcgcgtacccggcggcgtccgcgtacgtgacgtagccgtaccgggcgaagggccgcggatcgatcagcgccaggacgcgctcccggacggtgccaaaatcggagcgcgcggccgcggcccgcagctccagccgtcggcgcaactcccggtcgtcggcgacctgttcccgcaccagcgccaggagctcgtccctggacagcgccgtgagccacgcctctaggccggaggcccgcgtccgggcgtcggcccgctgccgcgggatcgcctccgcctgccgcagcacggtcagccccaccgccacgcagtgcttgcagaagttgccctcctgcccgtacgggcagtcgcaccgcccggaaactccggcgcctgcgccgagggcgagctccacctcgtagatgtccgtgccgtgcaccacggcagtgactgagccgtcgcccacctccagacccctcaccgcgtccacataccccgacccccgctcgaaggaccgagtccctgcgagggcccgcagttcgtcttcgccgaatcccatcgccttccgtgccacaccggtatccaaccgctcccacagagcggctggcgcgaaaaccgccgacctcacaaaaaccgtagggcgctacacagtggcacctgacagcacacaacggccgctgtggaaccatgaccacccaacccgagaccgcccaacgcgacctgcgcacaaaatccaaagagatcacggacgccgcccaaagcacccagtccttcaccatcacccgcgaaccgctcgccggcaggtagctgcggtggatcacgggccggatgagccggtaggcgcgctcggtcggggtcatcgtgccaacgctgtaaaggcggtagccgtcgtggaggggcaccagtccttcggtggcgagccgttccagagcggaccggaccacgggcacggacagctggagatccctcgcaatcttgtccagcgcgggcagatgggagcccggctcggtgcacgagagccgcgcccaccggcgcaccgactgcacgtcttcgtccgctggccaccacgctgcccgcaactgtcattcctatgctccccgttccggtcggtcagcgcagggcttgggtcacgcgatgtcgcagacggggcagggagttcttgcccatgaccgagagacggagcctcatccggactcgcgggcgccgactcgataacccatcgctgggctgcggcgagatcaggtgccgttccggctgggatgaaggtgaagccgtcccactcttccagcgcgcgtggttcgtcggggcggaggtggccagcgtcgccgtgcaggggccggtgacgacggtagacgtccagcggccggcggcgccgcttgctgtacgcggcaagcggattggtggcgtcgacgcgcgggacggcgcgggacggctggttcggtgggccgggtcggcggtgcttgcccatgcgctcgatggtctcaggcggcgatcgtagtcggtcggccggcggggagatccctcgctctgctgcgcaacgctcgtcgcctcccggctcaacacgctgctggacgccgcccgcctgcaagtagtccgcgctgatcaagagtcagggttggtttcggcgctggtttccgctgttctgacggagttggtcgatgcgacgggtgaggtcgtcgacgcgtgcggcaaggtcggggtggccggatgccagataggggtgcgtgtccttcaggcgagggacgagggcggcggggtcgttgtcggcgagggcggcggtgagatcagcgagtggggcgtgggcggcggcggggaggtcggggagtgcggtgatctggccggcgagctggcgcagggtggcggcgttggtgcgggcccaggcggagacggtgcggtcggcggcgcggcggtcccgggtggcctggacccgctgttcgcccgtggctcccggctttccggggcgtacgcgcaggtagcggcgttcggcggcctgacggctggcgacaccgagggggtgggcgaggtcggcccagctggcgcccgcctcccgtgcggcttcgatcaggcccggctcccagtcggccagttgatcgcgcacttcgcgcagcagtaggagcgcggcgagcgcctgctccgagctggcctggccgggcttggagggctcgccgtcccgagtggtctgggcagcgcgcagggcatcgtcgatcgtgtccagggccgcggcggcggcgaggaatgacgccggcgcgggaccgcatacgcgggggtcgggctgatcgtccctggtcatcgggcctccaatggccatgtcgtcatcttgatgacgtcaaacttgtcatcgcttggatgacatgttacaacgatgtcaggtgaacgcattggcagcactgcctgaccttgaaccctggaggtgtttcacgatgttgatgcgtaccgaccctttccgtgagctggaccggctcacccagcagctcctgaacacgaccggaacgtggtcgcggccgtcggcgatgccaatggacgcctaccgtgagggcgaggagtatgtgatcgccttcgacctgcccggtgtctcggcggacgcgatcgacatcgacgtcgaacggaacatgctgaccgtcaaggccgagcgccgccccgtcaccaaggcggacgacgcgcagatggagctctccgagcggcccctgggcgccttctcccgccagctcgtgctggccgacaccctggacaccgagcacatcaaggccgactacgacgccggggtgctgaccctgcgcatcccgatcgccgagcgcgccaagccccgcaagatcgccatcgggggcaggacggaacgcaaggagatcagcggctgaggcccctcccagccgcaccgcgggacgggggcggcgcgcaccgaagccaccccctttctgcgtccgccgcacacgtacgggagcagcgatggtgatgcgatgggaggcgttccttcaccaggtcaaggaacgcggcgactacgagaccaccagggaagccgagcgggcggcccgcaccgtgctggcgctgctgggcgcgcacctggtgggcgaggtgcgggcggaactggccgctcggctgccggagagtctggcgctcgtgctgctcaatccgctccaggcgcgcgagccgctatcccccgagcggttcgtcagggctactgcggcatggatcgagggagccaccgaacagaccgcggcctgggacgtgagcgccgtgctcagcgtcgcagcggatgcggcgggcgacgaactcacccgccacatcctgctccagctcccagcgggctacgacctgctgttcggccacccccaccccgtctgacccacgcacaggcagtacccctccttctgccccccgggccgccggcggcccggggggcctcatgagaaagacaaccgcgtcagcgatgatcccccagcagcagccacaccgcctgaagctgcgtgcgctgctcagagccggcgttcgccaactcggtgcgcagagcgtcgcgttcctgctggcgctggtcgatctcagggaattcgccggccgtgcctggattcatgaggtcgcgggcggctgcctcatcatgctccaggccgggggcggaggtggccgcgtccacgtcggtcccaggccagtaccagccgtactcggccatcgcctctcccgtccattccatcagcagtcgggcgccctcctcgctccgttccgtgtcgtgcccgccgcccgaggcgaaccagaacagaagtgcgccggctgcgggcttctcagcgtcgcacgcactgcacagctggagttggatcggccgaccgtcggtgtcgttctttggcgcgacgacgctcacgatcaggtctccgccgcaccgggagcactgcggtagcaggccagacgtctcaagacggtacactccgctccttactgaacgcgtgagcaccacccaaggtcctgtgacatgcaacgtcaacccttgcggccgcgggttatgtcgcccgcccggcgccgaacaccctgtcaggcaggggcgtcggcggccgcaggctgcccggtgctgtcgtctttcggggcaagggcggtggtcatggttcggaaccaagttctagtcaccaacattgccccgtgagagcggggcctgggcgcggccgttgtgactgagcgccctagtggcccgcctggccagatgcgggctcagttgggtgcgatgtcccgtccgctgcccaaggcctcgaagacgctggccgtcagattccggcggcctgcagttgggcgaaggtgccgaccttcgccgaccatgcctgctgatccggtacagcacgccagccgatcagcgagtcgggggtgacagtgtcgggccagatcatgtagccgagcatgacgagttcgcaccccgccgcatgtgcggcgtcgaccgggaatgtcggccagtcgggccagtgtgagaggtccttctgggcgaggggctcgaagctgccatcccggatcacttgcaggagatagccgctgtccgcggccttgcagatggcagtgagatcacggcggcagttctcagttgtcatggcagaacgctaagggaaacgccgtgctggcggagcgtcgggtacatgcccctgcatgagtccccgatgccggagccgtgtcgagagcgccgtcagcagcaaggggacatgggcggctgcgccatctgccgcatcgcgttcagcggccgacggcagttggcgatcgcgtcgtacgcgctgcccagaggctgatagcagtaggcctggtggcgagcggaccacaaccctctccaggctgcgtacggtgccatggcgtccaaccatgagcaggtgccgagctcccggacacccgtaccggaccagcgggggcgccgccgttacccggcgctggtccgcggtagccggtcaccgccgtggcttggaacgtggctgtagcgttcccggtgtcggtcaccgtcacctacgcatcgggggcgccgcggggcttgggggacgcttgtctcctccgcccacgcgacaaccctcccccttgccttgggccgtgctttagccgaaccgaactggtcaggtgtagtcgatgctgctgacagcgctgctgccgtcgccaccggcggtagcgttgccggtcctctccgtctgcgccgatccgctgccccggccctgcgggcactcaacgccggtgacagccgtgcctccgccgctcgcgcgcgccactccggtccgcgcggccgtgtcgtccgtgcggcttgccgggtgctggaacagcgccccgatcagggccgcgacgccgacggcggcctggatggaggccccgaccagctgccccgcatcggggctgtccagcagccagatcaacggcatggagagaaccccggccgccgccagcacgatgaccgtgacttaccgcccctgtgacatgccgcccctccctcgccccaacgcatccgctgccagtcggctgacggtccactccttgtggcggggtgtagtcggatgggcgcccctgtttcatgacatgggccggggcctggaggacaagggctctacgcacgtggggaagttctccgaggacgcggactccgtcggccatgccctcgatgcgcgccccgcgcaccggccgctagattgacccatgatttcacgccttcaatgcaccctcacatgggtctctccggagcctagattcagtggtgtcgccgggaacaccggtcggcgcaactactgagccccaggagtgaccatgacgttcaccagtgccccgaagcccgtcctcgtccgcgccggcgaggccgagacactgcaggacggtgcaaccagcctgatcacgctgctggccgacgcgaacaccaccggcagtgcgctgaccgccaaccgcgcgacgctgcacaagggctcgcccggtgctcccgcacacttccacacccgggcaaccgagatgttctacgtgctcagcggatccatgcggatcctgctcgacgaccaggtcctcacgctcggccagggcgactttctgaccgtcccgccgaccgtgccgcatgccttcgccccggccccggacagcgaggccgagatgctcgtcgtcttcactccggggatggaccggttcgactactaccggctgctggagcgggtgtaccagggcgaggcctcggtacaggacatccgcgacagctccgagcagttcgacaaccactacttcgagagccccgtctggcagcaggaactcgcccggcgctgaactcacgatccgatcgcctcccgcagagcccgggcaagggcggcccggcatgaacccgtcccggccggctcaagggcggtggcgtccgggtcgcaggccggggccgcaggtgtggtgaggtcgcaggttcaaatcctgccccgctaccaacgcaccggccccctcgacaccaacgtcgagcgggccgcaagccatgttcgttggcatagcgcagcctcaccgcctggtcatcgtcggccggggccgtccgccggcgacgtcgccgccgaggtggaattggccgaagccggtgccgtgggtgaggcccaggcgtcggagcagaagtcgcgccccgcgcgccaagccgcacgcacgatcggatccccctcagtcggcaacacgagtcagctgctcatcaggtccccgtcagcaagccctgccactgtggttcacgtgagcggcgccggcaccaccgggggcgcgaacgaggagaggtgcccggagtggttgatcggggaccagcgagcacgcctcaaggtcgggcccccgcggggcccacgcaggttcgaatcctgccctctccgccccacagaacacccggtcgggcctcaccttgcctccgcagggccgtggcggtgccggccgctggtcagttcgtacaggtgtcgagcatggtcgacagcgccgacttctcgtcgtcggtggtggtcagcttgaagacggatttgatgtgcgtgtagtccttggcgtacgtgcaccagaaggcatggttcgtcggctttcagtccgccggcccactgtccgacttcgaactgtttgacgacccgaaggcgatcagcagcagcgggatccttcaggcgttcccgaaggccttgcgctgatcagcggtccaggtgtcggcgccggagcgccaggcctcggcgagagggaccatgtggtcgatcgtggcctgggcgacgtcggtgaccgtggtgtcgccgtagaccgagtaccaggacccggacgccggctggcagtggtcgggcttgtcctggacgtccttgccgtcacgagccaggacagcctggcggtcgtgcagccgtcggctagccgcctgaagcccctactgtctccgtcacctctgccacgcactctgaagggggaataaaggactgggccccctcgtcggtggtgaactcggcctcagccaggaccagactctgcaggggaccgtcgaagacgtcgacgcccaagggaggcacgctgaaacgcgtctttgtcggcgatcacacgggtgaccgttaccgtccacggcttcggaggttcagccagcaggaaccgtctctcacgctcaacgcgtccatacttccccgggcaaaccgactgaccttgaactccaccggccttgtccatcatgagcacagcttctcagctgcttctccctgcgcggccacatcaagaccacagaccccgatctcgcgcccttccggatactgccaagtccagtgagaagagcccgaggccagtatcggcgaagatgacgaaccacagctcagcgatccgcccctcaccatgctcgatgacacactcgtgctctgctgatcattcgtcagagcacgtgacactccagcggcggaaccgtgtcaccccaagatgacaactcccagctcagagaccttcggtcagcgaacctcgatgagaacggacactgaccaagtcagctcccccggccgacagttcacccgatagaaggcatctccgatcttcacgcagtatcgcctggcgggcgcccttacagtctgtgtgccgtccggatgagacggcgtccgtcgctgacacatgggagtgggacgtgaggtcttcggggcgtatggctgtctcggcaatggccgtggctatggcggcgctgggagtaggaagtggtgcccccgcgtccgccgcccccacggcgacgccgtcgtgcagcgggacggaatgcctcagtctgaagccgaccaggctcacggccagccaggccagcctgaatgtcactcagatgcaattggagaacatcaacgcgatggcgtccgacgcggtgaccggggagcccattcgcggcgcgaagatcgtgttcgccaccacgggcggcaggacgctggggacggcctacacggactacgacggcatcgctgcgatcgctgctccggagaacctgggccccggaaccctccaggaactgctgggcggctacgaagccgcaatggtcggcgacggcgttcacgccccggccggggcccacggagcgatcacgatcggcactgaccagggccccggtgtcccgggcagcccatgcgccgtctgcagcgaccgtgcgctcaagcaagacgtggtcccggtcgactggagccggtagcggtgcgaatcttccgtcggcggtctcggacggctgaccgcggtgacccggcacggcttcgagccgagacgcgggagagcagcggtgtggcgccggtcggcccggtcaacggctacgcggtcctggagaccgtggccgcgctgcccatcagtacctggcgctacctctgggagccagaaggcgtacgtcacttggggccgatggcccaggactggcacgccgccttcggcttcaaccaggacgacaccaccatccccgtcgtcgacggcctcggcgtcgccctggtgtgcatccaggcactgcaccgccgcgtggaagagctcacggctgaaatggatcgtctgcgacaagccgcgagcgtgaacacgtccggggccgcgtgacgacgccagatggcctgttgtgatgttccagcactcggccggggaaggccagtggccacagtcgcccgccctcgccgagcgcggcccgcggtcgccatctcttccctcagaaggctggaggagtcggcccctgcggaacactcatcgcgatccagaaggcaggacaccttggcacgacacgacactgtgacgggaccatcccaggcgatggatcaccggtcaccggtgtgtacggacgcggtctggcggcttccggtgacggtctgtcgcatcacacagttcctgggtgagcagacggccggcgccctactggagcgcgccatcgactccgccggcgacacgttgcagccctccatgatccgcgaccgagaggtggtccccgactttcgccggtcccgctcgcgccacgacttcgccgcacccgagctgatggcagccatcgacgaggtgctggaggcggtcgagcacactctcggagtctcctgccagcacaccgaacccagctacagcctcaacgcgcacaacgacggcgacttttaccggccgcaccaggacaccagcgccgagttcgccccccgtcgtctgctcacattcgtgtactacctgcatcgcacaccccggcctttcgatgggggcgagctgcgtgtgttcgacgcggctctgccactgcacaccgagacagccgggagatggcaggaacgcacctggcgggactgggaacccgagcacgacagcatcgtgttcttcctccccactgcctggcatgaggtacggccggtcagctgcccgagcaagcagcacgcggacagccgattcgccatcaacggctggctgtgcagccccgaccccgcgaaccgcgggaatgacgcgagcccgtgagacacatcgtcgccgagtccgactggcgggatgcgtcccgtcagccgggctcgttcgagacgagggcacgtgagctcccgggactcgagcgtccggcccgttggcccggtcggtcaaccttcagtggcagaaacacgcgccggtcaacgttcggtgtcaatcggtcaaggttcagtgtcacgggacacagggcgtacggaggtggcctctgacacgagatcttgaccgtttgccaaacgatcttgacgcgatttccgctggccaaaggtggccaccttcgcgggctctgctcctcagcgacggtgagcgaccacgtggggtacgagtcgtggctggagcgggaccggttgatcctgctggaccgcgagctcgaggtgatcgggatggcctcacaaccggatgacaccgccgaccgcatcagccccagggtgtaaacccgtgggccgatgctgcgcgggaggggcacgtgacagcgttcccctgtgcccacggaccagccgcagcggcacggttgacgatccgtcaccacgggaggggccatgaccaccacgccgttcatcagccggaagggcatgacgcgccggagcatgctgggagccgcgctggccgctgtgccgctcgccgccgttgccggccccgcgtgggccgacccggccgcccccgccgtgacgcggctcatgctgcccgtgccgaccgggccgcacccggtgggcacggtccagctgcacctcgtcgaccggtcgcgtccggacgacatcgcgggccccgggcacttccgcgagctgatggccaccgtctggtaccccgcccgggacgttcagcggtacccggtggcgccctggatgccagccggcgcacttcaggcgttcctcgccgacgccgggttcagcgctctggtccgcctggggccgctcactgccggccacgtgggcgctccggtgcggcgatcgggccgacggctgcccgtcgtcgtgttctcgcatggcgcgcacagccaccagggcgaccacaccgtcatggtccaagagctcgccagccatggatacgcggctgtgacggtggctcaccaatacgacacgtacaccgagttccccgacggccggatagccgtcccgctccacgacgggcaggcgccgacgctgcccggggacttcgctgctgacctgcgcttcgtcctcgactgcgtcgagcagctcgccgccgggtgcaatcccgacgtcgaccacagggagctgccggccgggctgctcggctccctcgacccgcggcgcgtgggcgcgttcggctggtcgaagggcgggacggccaccgcctgcgccacgctcgcggacgagcgcatccgggccgggctgagcctcgacggcccgatgcagatgaacccgccactggccggcgacttggaccggccgttcatgatgatgtccgccgtgtttacccgggccacggatcccgaggccgccgcattctggtcgcacctgcggggctggcggctgaacattcaggcccagggcgccgtccacgtctcgtacggcgacaatgaggcgctgttcccgcaggtggcgaagctgctcggatggagcgggcagcagctccaggacgtgatcggcaccctcgatcccgaccaggcggtgaagatccagcaggcatacccgctcgcgttcttcgacgagcacctgcgccaccgtcgggggcacctgctcgacggcccgtccccagccttcccggcagtgacgttcctcccctgagtaccgcagcaccgcgttttctcacaggctcttgagggagcaggacgacgctgtgcgcctcacaggagcgggagcggtgggctacaggacggtgccgtgctgggcgcggcggtcgccggacgtagcggcgggcgacgaggccgttctcgagggtctcgccgatctgctcgcacagcggcgccaggacgtcggccgcgtcggtgtcggagaggtaggccggggcgacttcgagcatcagctccccgatcgcgtgcgtactgcagcgaggtcgtcgacgacggcgcgcagcccggcgagcgtaggatccgccggcggatcggcgggcgccggcggcggggcggtgcggacgtcacggacggcctggcggaccaccgggcgcaccgtcggctcatcgagcggatggaggccgctgggggcgagcgtggcgagtcggcgggtgatcaactccggacgtcgccgcgatggatcgacggcaccgggatccgggtccgccgcccggccgacgggcgcaaggaccgggagaagttcatctccggcaagaacaagcagaacgccgtcaagttcatggccgtcacggacgctgacgggcggctgctcttctgcagcccggccgagcccgccagctgcacggacatcacccatgcccgacagttcagcctggtcaagctcctggccaacgggccggtcgtggagatccttgccgacgccggctaccagggactgggcgctcagacaggagggtgtgtagtgacaccaccgcaccgcaagtgcaagaagaacccgccggactggtacgaagagatgcatgaacgcctgcgcaaagcccactcctcccggcgtatccgtgtggagcacggcatcgcgcacctgaagaactaatccttcccaagagcacccggcaggagcctcgcagttcctcggatgttcgagtcgggtgctggatgtatgccgggccgttgagggcgttggtgacgtcgccgaccagtgatgcggggtctcgccgctcgtgacatgtcgatcttgcgtgacctgggcgttcttggctgtctcacggccttgtcacccatgatcagtctcaaatccgtggcatttcctcgcgagggcgaggtcgagatcaggcggcttgtccgagtcggccgagtaccccacgccgagccccgagcacgagggctaccggcgagcccagatcgcgcaccgatgagtttcccgcgccgcgctggtctatacgccggacacccacgaacggaaggctgagccatgcggaaactgatctacggcatgaacctgaccctggacggctacatcgccgcggccggcgacgacatcggctggagcggaccgccgagcgacgagctgttccagtggtggctcgaccaggagcgggcgatcagcctgttgctgtatgggcgcaagctgtgggagaccatgagcgcctactggccgactggcgaccagcagcccaacgccaccccagcggagatcgagttcgcgcggaactggcgggacacgccgaaggtggtgttctcctcgacggtcgacaaggtcgactggaacactcgcctggtctccggcgacgcggtcgcggagatcactcggctcaaggccgaggacggtgggccgatgagggtcggtggcgcagcgctcgcaggggcggcgatgcgggccgggctgatcgacgagtacgcgatcgtcacccatccggtcctggtgggtagcggcacaccgttcttcaccgcgctggacagctgggcgagcctgaacctggtggagacacggacgtttcccggcggcgtggtcctgaccaggtacgagacgaggcgctgaacgcggtggtcgagcggtaggacagcgacgacgaccagcgacggatcgggtcacgtccacagaccgtcggcgagcagttcgcggtcgaacaaccgctgcgggtatcggagcgggtgcggacgctgctgcgggtcacgctgtacgcggtcgtccgtgacggcgcggtgcgggagctggcccgagtcgcagccgaggagtgttccctcgcgcgcctgctcagcctcggacaggacctgatgatcacccgcacgccggccccgcggacgggacagctgcgcgtctcggccacccgcctgtcacctcgcccaccacttgtccacggccctgaccgacactctgaacagggcggcaacctccgaccggccccggccctccaccaacgcggaaaccgccagcaaacgcacagcctcctgtgcgtccggtgaccaggtccacgcatcccccacctgatcactcacacaccgtcaacgagcgcgaacacaaagcgtttcagatcaatggtgcaccaatcagtctcaccatcgcctcgcacgagagatgcgccgcgaactgcgacgacggtgtccctcggtgcgcagaaggtcccttacacggaatccctggtgtgcacgcggttcgtcctgttcgatgagtgcccgggcaacgcgtagagctggttcctcgcccgctgcttcgaggggttgctcgccgtcggcgtggggggagtcgtctcgttcgccgaccccgttccccgtcggaccgcttccggggccctggtcctggcggggcactccaggacgatctatcaggcgacgcacgcggtgtacgccggccgggcgaccgcgcgcacggtgaagctcctgccgacggcaccgtcttccacgagcgggcggcgcagaagttccgccgcctggagcagggttacgagtacgccgcgacccggccgtctggccccgtgagtccctgaccgccgtcgacacccgcaaccggcgccatctcggcgcgcaccgcttctgcggacggcacggcgcctcggtgttcgccctgaacccgtacgccgcccggatctcaccccggtggcacttgaccgccttggcctgccagtcgtaggcggcccactttcactgctctcgaaccgctccgcccgtcggccgacccgccgcaagccgagcaccgaactggtgctcgcctggcatgctgcctgctgatcacctaccagccgacccgtcaggccggcacgtcctgacctcaatcgcgtaccgagtcgcaagcgagggcggcccacgggagcgcctgacttgaggacgcggccgctcacccaggcgcggagagtcttggagccgcaccgccggtcgcatcggccgtggcctgccattcgcgcggcgacatgccgtaggcggcgcggaacgcccggctgaagtgggcggggctgacgaagccccaccgcggacacggccggcctgctccggcgggggcggctgagctcgcggccgcactccttgagacgacggccgcggatccatccgttgaccgtcgtcccctcggcctggaacaggcgttgcaggtggcgtacggagatgtggtggtgggcggcgattgcttccgccgacagggccggatccgcaaggtgtgcgttgatgaagtgccggatccgctgcagcagggtctgccggccggcgtccgtcggggcggcatcccggccgagccgttcggtgacgaccgtcgtgagcaggtctcccacattgcgggcgagcaattcaccgacctcggggctgtacgtcccggcttcggcggccagactcgacaggaacggcgccggttggagccggtcgcgatgaactggtggatgaggtagccgcaccgacgcctggggcggctccgtcgagggccgcatcaagttcaccgtcgaggtcaccaaggccgtcaccgcagagatcggctccagcgcaccggcctgcggatctcgcccggcaccacgttcaacgacatcgaggagagcgacccggaggcgacgtacaccgccctggtcgagccatcgagccactcggcctggcgtaccggcacgtcgtggagagcgccctggacaaccgcgagctgaccctcgccctgcgcaagtgcttctcaggcgccttcgtgctcaacccttcgaccgagggcccgaccggccccgacgagctcaccctgatcgagtagacacggcccttgcgctgggcgtactcgtccacgccggccacgcggagtacagcggtggcggggtccggaagcgaggcgatcagcctcaacagggtgttccggctgaccggaaccttgaaggcgtccgtcatccgggcgccggcccggccctcgagcgcaagaccgaccgacaccagcgtcgaccgcagccgctcggtccgtcgcccgaacctgcgggtgagaccgggtacttgctcggcgaaggtcatgcgctcgcaggattcctcctcgcagacgaacctccgcacccgcaacggcaccacgacgcacttgcccggcgtcggcagatcacgaggaaatcgcaggtaggagccttgtattcgccccgcccagtatgcgcaccccacacaggccgcccgccctgcggtcgtacgggcctcgaccctgacgaccgtgccgatcacctcgaccgattccaccaacacgccctcgaccgaggaaaacagcagctcgttcaactgcggcagcacttcgttcacggcgaaggactgtcgaccacaccaccgtccagcctggcgattttcgggcgaactttagtggtcgtaggcggtcagtgcgcgcacaactggctggccgcgaatgaacctggctccacactccactcatcaggtcccattggaatcgatcatctagggaaccgggaggcgctctaccggcggaccgccgagatcagtccgccgggccgctcctcgcgctgcggcggggtgctgatcgggcggccgtaggcggcagcgcgctcgcgcagggtgtgactgtcggcctcccagccgtgcccggccagccagcccaccgggtcgtcgggcatctccgagacccacatggacgccgccgatcccggcgcggcgtccgcgccgaagcgctcgatcacgccgcgcgagcccaacgtcagccccatccgactgcctgccgccgactgcgcgctgatccgggccagcagcagctccaccgcgtcctcgggcagatagatcagcagtccttcggcgatccacacggtcggcacggccgggtcatgccctacggcggccagcgcgcctggccagtcctcacgcagatccaccgcgacggtgatccgctcgcagcgtgcgtcggcccgttcctggcgcagcaccgaagccttgaagtccagtggcgcggcggtgtcgacctcgaacagccgggtgccctcgggccagtccatccggaaggcccggctgtccatgccggcgccgagcagcacgacctgccggaccccggacgcggaggcctgctgcaacaggtcgtcgaggaacttcgtcctgatgacgatggagaacgacacggtcagccggcggcgtcgcgcggcttcgtcatcgggcagcggcggcgaggagggccacaggccgccggcggtggcgaaggcctgtgccagtgggtcgcggaacagcgcgttctcccgctcggtctccagcgcccgcaccctggccacccccaccgccgtggcccacacgcccgacggctgcacccgctcctgctcatcagtcaccacgccagcctagaagatcgattccaggaggcctgatgaagggagccagcttcatgcgcggccagccagacactcagatgtgtctcacctactggtgccgtcgtttcaggagcctgtgcgcgagggtggccacgggagtttgggggcgttcttcgtcgtagacatgccgatatgcgaccgggtcacgtcacgggccagcagctcctggctgatcgggcggttcagaacctcgatgatctcgttcggctgcatggttcggtttctccttctcagcgcagttgctcggccagtccgacgatgatgccctccgggccgcggaggtagcagagcagatagctgtcctcgaaccgggcgatctcgccgacgagttcggcgccgtgagggcgcaggcgggcaacggtgtcctcgatgtcgtcgacggcgaacatgacgcggtgcgtgccgagaatgttgtgcggccggttgcgcggcccggcgctgatcaccgcggggctgcggtacttcgccagctcgagccggctgtgaccgtccggggtccggaccatcgcgatgtcacagcggacgccgtcgagtccggtgcactggtcggcgaacaggccctcgacctccgccctgccctccagctccataccgagttccacgaagaacgcgatggcggcatccaggtcctcgacgacgatgccgacgttgtccatccgctgaatcgccatgcaggtttctccttcttccttgtgcggccggtggtggccgctgctgtccctgggacggagccagtggcacgttctcgacattgtcagaccgccgaactccgaaaaatctggatcgcgcctcagcacccctacagcagacccgcgagccaggcgccaccaccgtgggtgagtgcggcgcaggtggccgctcccatgaagacgatcagccgcagcggctcgcttcgggccgccgccgtcgtccgcgccggtgccgccctcgcagcaaccggactcggcgccggcctgctcatcgactccgccccggcctccctgatcgggtggatggcgctcggcctctgactgtcaactacggtgccgtccctgatcagcgccgcaggacgcggcggcccccgagccgtcggcgccgtcgctgcaaccggatatctcggcccgctcacagggcctgccgtgatcggagcgctcgcctcgctcagcagcctgtccgtagccctcgccctgcccgtcctgctgacggcagttgtcgccctttccgcccatcgagcattggaaccccgatgaccgcacctttccccacacctgtcccaaggctcgaggccctgatcctcggctaccacggcgtcatcggcaagcaacccaccagcagatgtggctacggctggccgcactcgccggatggcccgccgatcagaccgccaacttcgagatcgagttctgggcacgccgcgcgctgtacgacgccggcgagatcagcacccacaccttctggagcggcatgctgtacggccaactgaccgccccgccgggcagcaccctgctctacgcactgcgcagcaccgacgccgagatgtggacccacaccgacgaggacgtcgtccgggtgtcctgtctcactgaaggttgaccgatctcaccgaagattgatcagtgccttccgatcagcgcaggcgtgtaagccgcaatagggcttcgttgcggacatcggggtctctgtccgctgccaaggtccgaagctgcacgatcagctcgtcgccgtcctgtccggtcgcccagcgtgggtcacagtccagctccgcagcgagctgatcggcggttccctggtcagaggcgactgtacgggcagcgagcacggcacgcaggccagccagatctctccgagccaagagagctgacgcagtatctgaggttacgccggtgtcctgagcgtctagcaacagacggtgcaggacatcggcgacaccctcaatctgccgtgttgccgccagacgtcgtcccgcggcagccctcacagaccaggccggcgattccgctgccgcgatcgcgtcgcgaagcccttgctcggtgaagtcgtacacaccaccaggctgccagcgggatgtctcgatcacgcttcgttgagacaacaccgcagcggtcaatcttcggtgagattggtcaaccttcagtgagacaggacaccgggtcctgcaagcagcacacgcaggcggccttcggatgactcttctgtcgaatgtcccgcacccgcttgcggaggcactcgacctctctgcctggtgcagcaccctgatgacgaggaccgtctactccgcccggctcggcgtgaacaagccggacccgcgtgcatacgaggccgccgtcgtggctgccgggttgccccacccggaaaatactctcttcgtcgacgacaggcttgagaactgcgctgtcgccgcccagctcggtctgcgaacgctccatttcaacggtgacagccaggcactcgcttctcacatcccgcagatggttcctgcgacggggatccgcaggaactgaccggctcccgcctcgttactgagcttgttggcgttttgtcgtcaaggtgaggccggtttcggcgaggcatccgtcgatgaggttgttgcggtactggatctggcggaggccgtgccggagggcgcgcatcaggtggccggggtcggtgaaggcggtgttggcctggctgctgcgtcgcagcagtgaccagacgccttcaacggggttgaggtcgggggcataggtcggcaggaagaagcagttgatccagtcgtgggcgttgatgaactcccgcagccggcggtccttgtgaacgttcaggttgtcccacccgagcacgatcggggcgccgagctgctggtgggcggcgatgagcaggtcgcggtagtcggtccaggcgaaactgcgccgaccgcctcgcttgtggtccacgtgccgtttggaccggtagaccaggcgtgagcgctcgccctgtttgtagcaggccagagcggcgatcgagatgcggcgctgggagcgtccccgcacccggatgacaggtgtgtgcccgcgcctggcccaggtgcgggaggtgggcggcgtcatcgagaaaccggcctcgtcttcgaagcagagccaggccccgagcgccgccacggtgtttccacctggggccaggtctccttcacccagcccgtgacggtttcctcgttgcgctccaccgctcggcgggccgggacctggtggctgaagccgtgccggtgcagcatctgcgcgatggccgacagcgtcatgctcttatggaaccgacgcccgatcagcgtcttgatccgcgacagcgtccaggtctggtccggccagccgtgcgccaccggccccttgcccagctcctgctccagtaccgtgaacaacttctcgctcagcttgggcagcgacaccggccccgccgaccgaagaccgtccgtccccgcgtcctgccagccccggcgccaccgctgaacgagcgcacactcatccgtaagtccttggcgacctccgcgttggaggcgccggcgccgaaccgttcggcggcctccatccggatccgctcacgaaacgcctgccgttcaggcgtcatcccaccaccctgcggatacctcatacaaacggcataccgcgaaggtcacacgccgtcagcccccaacgacaacacgccaacaagctcagtagcagtcatcaggtgtggcgaggtggttcatcccatcctcttctcggtaggcgatgtagccggtgctcttggccgtgcccgagaactggatgtagaaatcggatccgtccgacacgtctgtggcggccagtgcccactgtttcgccctggcagtactccacgcgttgcacgatccggtggccttgaagcaggtcctgaccgaacgggttgcgttgaccttcaggttgatgtcctcgcagtcccgggtggttgtggcgtagtagcccgtggcgggccaatgtgcgttgccgccgccgctacccggcgtgccgtcgtacaagaacgcggtgtcaaggcaggccgcccggcggagcctgcccggctcaccgtcgacgccctggaggtgctggcgaccgcaccggcgcgggcattgcaggagatggtcctcgacaggtacgcacgactacgtcgtggtgttcgacgccgacaccgacgccgtgcccgtcttcaccgccctcgggcggtgggtcggcatggcggaaagctccggcaccatcggcacgctgaccgagatccacgagcgcgtgaacggcggtgacgcgtaatggccacgaccaccgcgtagtttcacaccgtcctggagcggttccccgccggaggcccccgaggtggcgtgcggaagagtacgccgccgaccaacacgcccagggcacggacgcccgggtggtggtggacctcggcagcgaccagttcctcgtggtcaccgacatcactcgccggtagcaccatcccgagcaccgcggcccggcttccccggccgggcgcggcgctccgccgtttgctcaccaccgagcaggaggcacctcgtgcaccctgaggtctctaacgcagtcgcgctgttgcgaggtggattttgaaggcgcaggggacgtgtccctctgacgtcgtcatatccctcacctcggcaaaaaaggcttctcgcaaccgatccaaagtcgcgcgatcgagcgggccaagatcataaagactggaaacagcagcccatacctgctcccctggtgcgctcagatcgataggaacggtctcccagtcaaccgctgtgaagcctgctggcccgaggacttcatcaagcccctcgcgactgcgtgttcttttgtctcccagtgccgggatgcgctgcgaggccggcgtctcctcgatcgtgcaccgcagcagggcgaggaatcgttcgtaggcctcgccgcctacagccccacctcccactacgcatgccagtacccctccgggagacagcactcgggcaacctcagatgcgacttgctcgatctcgctcatcagcatcagtgccatgtgggagacgcaggcgtcgaagctgtcgtcggcgaagggaagctcttgagcccggccctcttccagcttcgcttcggaaagcgccggtcgacggcgtgccagcgccagagagtgcggagacaggtccaccccggcgagttgtctcccggaccttcgggccaggaactcgagcagtaggccatcgccacagccgaggtccagcacgcgcatgcttccggctacccgatcgcacaagatctcatagctggaccggccgtctggagcatggccacggccgaacgcttccgcggtcaccgccgggtactccgcgtggaatgcctggagaaatgcttcttgcgatgcagtagtcgtcactcccccaacctacggcgcaggcttttcgcccggccgtcctcagtccggaagtgtgcaagcggcctcacggaactccgtgcccgaacgctccaggcgccgcggccgaggtcgaagtccagcacctgcacgtccacccggcgcgtgctcaacgagcccggcaacaccagcaccggactgagcgcataaccaccacggccccccacgagagcgagatcagcgaacaccggcaggagcaccgcgccgccctcgccacccgctgacccacacatcgtgccccggacccgccccttcgggccggggcacgcccccatgcctgcggggcggccgtcgacagagaatccggccgtcccgcagcccccgccgacaccatcactccctcgaagggagccccttcatgacggacagaccacccaactcacgtgcctgcgaaccagggtgctggccaccgcgtacagcagcagcgactgctggacccagcgcacggcttcctcaccgaccaggccgtggcagcgctcgccagccgtgaccctgccgcagccgagccctcgccgcgtccctgctggtcccggagacgctccacaacatccagatcctgggcgcggccgtggaagccggaattgacaccagaacctgggaggaacgccacgaggagatccggacctacgcccgcgacgcctatgaactgcccccgcagttcgacccggcaaccgaggtcaatcggatccgggcgtacctctacgacaactacccccagatcgccgccgccctggccgtcttccttcatgagatgccgcccacctggcgcgaggacctgtttcaccatctgccctgactctccaccgcccgccggacggcctctgagctccccggaccggagacagcgccatacgacccgctggactgaaagaactgcccggcccgggccgaagcacagggaccaatgccgctaccaccgcggcgccttcgccagcacggagtaccagcgcgccccgatccagacggccttgaccgaccacatggccaaagaccagctccagcagcgccacgccgaactcgaggcgagcgctgcccggacaccgactgctgacgcgagcgcctcctcaccccgtgtcgcccggggcagccgtcgcccctgggtccggccgccccttcgtcccaacccagcctcaggaacaggacacccccgctgcggccgctttcgcccatgtcccttggctggagagtgaaggagaagggacggggcgggatgggcgacgccagaccatccgccgcatgggcagctgccatagccaggctgctcagccggtcactcggtgcggctcccctatcaggccgctgattactgaccacgcgaacacgccggtccacgtccgcaccgtggtcgccgggtggttgggttcccacctctcctcgtagtgaagctcgtcgctgctgagagccctccccgccctgcagctcccgctcgacctggttgatgcaggccgtgacgtccgcgtgggcggcggggccgtgaaggccacgccaccgagcgcgaggggccggccggcgaggacacttgcgatccggatggacgtacgcatgggacgcacctgctctccgggatcgtcgcgcgggccgggagctgagtgttgccggagcatgggaacggcgccgggcgcacgcgggcccgcgcgcaaccactggccccgggtcggctgggtttccctcccccttcgacgctagatcagcccccgcacccgctacgtcttccgcgcggacgtccagccctggcggcggaggctttcgaagccgtccaggaggaggtccagggcgaattcgaactcgaactggtcgtcgcagccgccaccgaccgtggagcccccgtcgtgtgcggccgtcgcggccagttccgcgatgtgcgggtagcgcgccgccagcccggggtccggcgggccggaggggcctgaggtgtcgaacagttcctggctgaagccgagcaggcggctgcccatcgcgtgcatgacgtggtgcgtgaggtcggcggagaggccgccgtcccggaagctcccggccatcgagtccaggtacgccagcacggccggggtggggccggtccgcgactcgatgacccgggccgcccaggggtggcgcagcaagacccgccgggccgagaggatccgcccgcggaccacgcgctgccagtcggggcccgcggctggcgggtcgatctcgccgacgacggcgtcggccatgccgtcgagcagctcctccttgttggccacgtgcttgtagagggccatcggtacgacgtccagctcctgcgcgagcctgcgcatgctgagcgcgtcgatgccggtggcgtcggcgagcgcgacggcggcgcgcaggacgcggtccctgttcagggggatccgttgcgtgtgcgtggcttcctgccgggtcattccggttcggccccttccctcctcgacagcgccctctccttgacgagtgtacgccgtacacctatggtcgctgccaggtgtacggcgtacaccaccaccgagcgaggggtaccgaaaagatgagtccggaccggagaaccgcggtggccgccgggtcgctgttcctgctgaccgaggccgccgcgatagccggggcggttctgtaccgcccgctgctgggcgcggcggacggccggctcgcgcagggcgccgacacgcgggcgctgctcggggtgctctgcgaggtggtgctggtggcggcggtggccggtaccggggcggcgctgttccccgtcctacgacgccacggcgaggggctcgcgctcgggtacgccttcgggcggctgctggaggcggccgtcatcgccctcgggatcgtcgccgtcctggcgctcgtcaccctgcggcgggacgcgggggcggcggccggcgccgacgtcgcgctggcggccgtgcacgactggacgttcctgctcgggcccaacatcgccctcggcctgaacaccgtcctgcttgcgtacctggcgtaccgcgcacggctcgtgccgcgcttcatcgctgtgctcgggctggtcggcgggccgctgatctgcgcctcggccgtcgccgtgatgttcggggcttacgcgcagctctccgtggcggggtcggccgccgcactcccggtgttcgcctgggagctggggctggccgggtggctgatcgtcagggggttcgggcccggctcaggcgccacgtcccaggcagacggagaggtggctgatccggtatgtgtgtcggtgaggccgacccgagcttgacggcggtgctgtccggggcgacgcgccagcgctgccctgccgggaccgtgtaggcggggtgtggcggcgacggcgttgcggagcttcatgcggggatgcatcccttccgaagatgatcaagaggtcactgcggggccgaccccaggagggccgcgagcggcgaatcgatccgccgcgggccgtcggcacagcgcgtcctctcatcaccactcgttcgggtcagatccgccggaagcgccgccgggcgggatcgaggccacgattccggtccccgcggaccgtgtccgcaaccggctggggcccgaccgtgcaggtctccgacagccacggcaccgcccgcgcgatggcctgataccgcattcatcctcgcctgaccacccgctccacatggaccgaccacaccggcgaactccccctcatcaagggcacgttgaaatgcctggaggccgacttcctgcccggcgggcacgatccgctcccagtctgactgtggtcgtcggccacggggtcgggacagggcatcgatctgcgctggcaggcgttcctccgcagattcgacctggagcaaccgttccggataatcaagcagatgctgggctggacccgccggaagctccgcactcccgaggcgacggaccggtggacctggctggtcaacgtcatcgtggctcacgcccaactgcgcctcgcccggccgctggtcgcggaccttcgccgcctctgggagaagccggccgagcctggccgactcactcccgcccgggtccgccgggggttcaggaacctccgccccggcttgccctgtccggcccgtgcaccgaaacccaaccggcccggccccggccgaccacccagctcgaagaaccgccaccccgccacccgcaaggagtggctgcgggcgactcgtaagggcggctctttctggtcggtgccgcaaacacgcacacccgtcgcaggccagctgggccctcttcgtccacgtctccgcgctccacctacgcatcgacaccatcgaacaggcggtcaggcgtcagcccctgctgtcgtacgcccgctggcagttctggatctctttgctgtgctcgacggtccagtcgtagagatgcccgaatggctcgcgcagggactcgcccagcggtgtgagggagtactccacgccgacgggtgaggtcggcagcactttgcgccgaatcatgccgttccgctcgaggcggcgcagtgtctgggtaaggacgcgctgtgtcacaccctccaggccgcgcttcagctcattgaaccgggtgggccgttccagcagcgccatgaccatcatcgaccacttgtccgcgatctggtcaaggatcggacggctcgggcagtccgcccggaaaacggttggtgtttcggcgccaactgcgtgcaggtcggtgtccttcatgtgccttggtgctcccaaagtgcgttcttgacgatccgagcggcgccgccgacggtaggtatgcatcgcaaacttacatgccttttgacaacctacggagccttcatgagaaacgatgcctactcgaccctgcgcgtgagcagcgaacacggcgtcgcacggatcatcctcgacaatcccccggtgaacgtgatcggcgcgacgatgatgcgcgagctccgcaccgtgctgaccacgctcgcggacgattcatcggtccgagtgatcgtcttctccagcgccgacccggaattcttcctcgctcacgtggacatgcggatcggggagaagatggacgccctccaggaactcgccgcgtcggcgccggcggacgtcaatgtgttccaggctgtcggcgagctcatccgccaccagccccaggtaaccatcgtcaagctcgccgggaaggcccgcgggggcggggcggaattcgtagccgcagcggacatggcattcgccgccgccgagaccgccgggctcggtcagatcgaagcgctcatgggcatcatccccggcggaggcggcacgcagtacctccggggacgcgtgggtcgcaaccgcgcgctggaggtggtcctcaccgccgacctgttcgatgccgagaccgcagcgtcctacggctggatcaaccgggccctgcccgccgacgagctcgacgagtacgtcgaccgtgtcgctcgcaatatcgccgcgctgcccgacggtgtcatcgaagcagccaagcgctcgctgcccgccgatgacctcaaggaaggactcctgggtgagaacgacgcctgggctgctacgttcagcctgccggccgctcagcagctgatcagcgggggcctgaaggacggggcacagacaccggccggcgaacgcgacctcgagggactgatgcgcagcgtcgcgcgctgattgtcggacgtccacctgcacaccgatggccccggcacggaaacgcgccggggcatctggcagttcaggcgtcaccttggcacatcaccgcaccggtcccacatccgtcctgtttgcctgtcacttcagagagtgagtgacgtggatgatctcgtgcggtggcttcgcgaccagctcgaggacgacacgcgggtggccgaggctgccacgcctggcccctggagcgactgcggcgggtacgtgaccgacggccccggcgcgctgcgttgtgcaggtgactgcctatggcactcagaacgaggaggacgccaggcttcgagggcaggccgactcttctcacatcgctcgtcatgatccggcgcgggtcctgcgcgagatcgaggcgaagcgcaagctggtcgacgattacgccgaggtaaccgcgaatgacgtcgacgagcccggctgggcgaacgcgttcggccacacggtacgtctaggcttttctgaacatttgcgaatatgtggaacaccctgccggcggccacttcgccgcctgggaacagcccgaggcttacgtcgacgacgtacaccgtgcggtcaagctgggcggctgaaacggagcttgcggatgctccacaaccgcaacgccgtgcgcccggaacggcccatggcgtggcagccgacaccatgaacgttcgtggtcacagccggctcggccgggatcccccggtcaccggcaggtcgtacgcggtgagttctccgccgaccgggacgtagttgcccgccagctggggccgggcctgttgcacggagatcatcgggcaccggccttggcctggacgcgggagacatagcggacagtgaagatcatagggacggcgaagccgacgacctggatgagcatggcgagggtcgagtgggcgttcccggcgtgcgccatgaaggcgagcacgacagcggtcagggtgaaggccgcggtccagacggcggtgatgatgacgttggtctggatgaacggcttgagtccccaggcctcgcgcggggtggtgcgcttgacaatgcccaacgtgaacggcttgccgatggccagcgagaccctggcgatgaccgccagtgtgcccgccgacagcgccgccgagtagtcgtgcacaccgagtccgggttggccaaggcgatgacggccggcacggcgaagaagaccgcggagccgagctcgatgatcagcgcgtcgaatccggcacctgcccgtatctgctggacgatcacggccactgcaaccaccagggccgggcgttcgcgagggcggcggccaggtccgccgacattcctactcgcaacgcaatccctcggaccggacagcagagagcgccgagaccgcacaaagtgaccgtcacacccgcacaccctccggggatccatccctccgtgcccacagcatgtccattcagagcggatgaccacggtcaacagcggtgcgagccgcctcgcagggctttcccgggagacggtatctatgcaggtcagatgccgcgtcgccgtacgagcgccgtcgcttcccaagccgagagcgcagttttggggcctctcgtgccctgccagattcggtcaggccgaccgtgcctcaaaacatgcttgagcgtcttgccgtccttctggaccatgcccttggggtggatcggcgggagccagccggacatacaggcgtcctgcggattggagcgggagtacggagcccccggtggcggtcgctgccctggccgggtgtcctcagccgtcgtacctgcgggcgacgtagacagtgttggccgcggtcccgccctgaagcggattgtcgaaattgaccacgtgcgcagcggtctccgtgaaggcctccgcgagcaccgagccgaactcctcatccggcgggtcgttcgaccacagcgcgaacacgcccccgggatggagtagttcggccacagcggtcagaccggccaggcggtagagcgcggcatggccggggtgcagcacatggcgcggtgagtggtcgacgtccagcaggatcgcgtggaaacggcggccgggagtctcggggtccagaccgcgcggagccgcactggcgccgcgggccgtgcccccagcaggcaccggaccgcccaccttcgcgccgtccgcgggcaccggtctggccgccgccgcgctccccgcagccatcgcgaagaagtccccgcgcaccagccggcaccgggggtccgacgccagtcccgcgcccagcggtacgagcccgcgccggtgccagtcgatcacctcggccagggcgtcgacgacgatcagcgagcgcacccgcggatcgtccagcgccgttcgggccgtgtaaccgaggccgagtccgcccacggcgacatcgagcgggccgtcgggcagctccgccaggccgagccgggccagctccacctcccccgcggtgaagaggctggacatcaggtactcgtcgccgagcttcacctcgtacacgtcctcccccgacacggggtcccgccgacgccgcaggctgatctcacccatgaaggtcgcccgccagtcgatctcctcgaaacgcgcgctcatccggtgtccttctccgcgtccttgtccgctgccacggacgggttggggtgcgccgcaggaaggtaccgtacgggccggggcggggcccgatgccctgcagggtcccacacggagcacttctggcggggcgatcacacaaccgcacaccgccgcatccagcagcgcatcttgacttctaaggcggtgctcactctgacgagttcagggcgaagaagagaagccgccccgccttactgggagccaggtgtttgacatcgccgccccgctgggagccgcctcccgaccgtccgagctgaccaccgtccgggatcccgttgcacgagatggcgcggggcggatcgatcaccgccgagtacgggctcgaagtgctcaacaccgtgatctatctgccgcgcggcgagatcttcccgatcacctcgagcgctaccttgtgcaacggcttcagcagacaccgggacgggagcttgcaaccaccctcccacgtcggagctggcgcggtctggcgtagctaagttggggccatgactggtgactggaggatggatcggatcggggctgctctgcgaggtgagaacccgaccgtgctgcggcggcttgagtcggggttcgcggtgatcggcgacgttcagttcttgccgggttactcggttctgctcgtggacgaaccaggtgttcagcggctgtctgatctgccgaaggcgaggcggctgtcgtttctgtccgacatggaccggctcggagaagctgttgagcacgtctgccaacgcttggaccccgacttccgccgggtcaacctggagattctggggaacaccgacccgttcttgcatgcccacgtctggccgcggttcgagtgggagccgaccgagctggtgggcaagcctgtgtggctgtatccgggtgaccggtggagtgacgaggggttcagactggggccgcagcatgacgtgctgcgggacgggatcgagagcgaactggatcggttgcgttcgatgggctgatggcgtgagcccgccgaccgtcaggtcggcgggctcggtgatcagtgacagtcagtggacgacggtcactgagtccttcgcagcggaacgatgtcggggctggcggcggggagggaagtgcgggcggcttcggggatcgcgagaagcccgacgatggtgaccggctggtggcagtgggcacagttgcgggtcgcggtcggttccagcgggtcacgttccgcggccgcttgctgacgcgagaggggccggcagagagtttgggacggtgcaggcagctcaggccacgacggcagagaagtggtctcaccgagacgacgcatacggtcttcgtctcttgcctggtcgcggcggcgttcggcgtctttgcggcaggccggggaacagtagatctggcgggtggttttcagggcctcgaacgggccgtcgcagacaaggcagacgcgcgctcccattgccggtcgacgtcggcgaagctctggtcgccgcccggcctcaactgtcatcccctcacctgttcctgacctgtcgggccccgcgcggcccgatccgcgcggacctggtgggcgatgtcgtcgaacgggcctgcctgcgtgccggcctgcccccgcgttggtccgcaccggctgcggcacgcgctggccggcgagatgctccggcaaggcgccggactggccgcgatcggccaagtgcttcgacatcaggacttggccacgaccacgctctacgcgaaggtcgacttcaccgccctgcgtgcggtcgcacagccctggcccaggacggaggcggcatgaccgtcctgcgggaggcactggccgactacctgcggcttcgtcgctcgcttgggcaccagatggccgagaccgcctggttgctgccggacttcgttgccttcatggaagaccgcgggcagaccaccgtgaccatcgcggccgcgctggcatgggcgaagagccgtgagggcgaggtggtgacgacggtgagcccgcgccgggtcacggcagtccgcggcttcgcccgccaactgatcggcaccgacccagacaccgaggtcccgccgctgggcctgctgccctaccggcagcgctggcgtccgccgtttctctactccgacgccgacatcgccgcagtgatggccgccaccgatacattcgacccgccactgagggcggcgacctaccgaacgctaatcggactactggccgccaccgggctgcgagtcagcgaggcgatcaacctggaccgcccccagccgaaaactcagctcgggtagctgcgaggagattcgttgcgcaacctccagatctccttccacttccgggcatggtcggccgccaaccgcgggtcaggcgctttggcccgctgtaccgcgagactgaccccgcattccctgcacagctgatggatccggtaggcgccgtcgtaccagacgctggtgttgtcccggtttccgcatacacggcacgtcagcgcaggagcttcatccggcggcactgacgaacggagcacccgctcgaccaccgctggcagcggctcgtcgggatgaattgtcggctcgggacagtaggcaatgttcccccactcacgctgccagcctcgccaggactcgtctcgtttcacctgccgaaagccacgcgctttgtcagctcggcgcctgttggcataggcacgctcgtcagcgagccagagctgtcgggcgtggtgcaactcctcgacggcacgtatgagcgagctcggatccttctccagatccttggggatccccgcgctgaggcagagatggtgatacgtggcccggaagccgtagggcgcgaagtggacgaggcacgaccgcaaattcgtatgccgggcgcgcgtcggcaggtcctcgtcgtagacccgtctctggtgcgtgttgaagctgctcatcccaagacgctatgccttaccacacacggatcgcacttcacttcgactcaaggtttcggctcggccgtgttcttaacgaaagtgctgccagaaccaaatccgaatatcgccatcacctccacctggctgccccgtacgccggctactggtgccagtacgtcaccgactgggtcgccgacaagacccgctaccgcctcaccatcgaccccaccgcactcgcccaacgcctcgccgaatgccccgacctgcccatcaccatcaccctcgcgcgctgaccacgaacctggcccgtcgccacgggggaaggcgacgggccaggcccacaccaccgtgccatccccgcgtatggtccgggcggcgttggcgcggccggtgagggtccatgggacaggcggctcggcgccgtcaccggctcgagcactgggctcaggagctgatcggtaggtccttgcgcgcctgctccaggtcggttgcccagatccacagccggtgctggggcggcacttggtggtagccgtacaggccgacctcggtcagcgtccgcaggtccacgcacacccgctggtaggcctgggcgatcgccgcggccggatcggtcagctccttggtgccgagcttgatacatgcccggtactcatatcccagcagcaggtcctgcccgaactgcgcccaggcgccaagttgctgtgtccaggccgcctcggcctcctccagcagcaggttcaagtccttggtgggcgggatggaggggtagatgacgaacgtggccgcccagccgagcgccaccatgtccaggttgaacgtgcgccgacgggggtcgtcgcggggcggcagcggatcggaggcgctgccggtgaaccagggcgcggtgtaggccagcaggcgtccgttgccctcgacgagctcgccggtggcgatcaccgccatcttgcgctgggacccgtcggggtgcgccaagcggctggccaccatggccgtgtgcgcctcggccgccgcctggcccgccgactgatgccgctgcgcggcatcaggggtgatccgggagacgagatagtcacgaagatcctgcggcagcgcgtcgtaggtgccatccagcagtcgcgtcttggcacgctccagagcggcctgggcggtggccggggccccgccgtagtggctctccggggtgtcgatggacaccatgcggatcgccatggcgatgttgggggtgtcgccgtcagtgacgctcaagaaccggtagtcgttggcgggccggctggggcccacgaagccgagatcgaccacagctgctctcccgaaggttggcccgagggacgagatgattgggcacccggcacaaacatcacggctgatcagggactttggtgcgggccgactgccggttccctagcaattcctggctccggcctccgccaaacctgcgagctcgtgtcgtcgaggttgtgctcgttcgtgacgtcggccggtgatcgatgcagacgccgccgacagaaattaccagcggagcagttcgccgtcagttgccctgtgttcggtggccgcatccgtgcccgtcacgacgtactggcccttatcagggatcttcgtcttgtggtcgtcgccgttgacgctccagtgcacaatcacactccacttgcatcggtgcgcggtggtgtagacctcgagggtgacgcgctctgggtcggtctgcgtcaccttgtacacgggagggttgatcggatcgccacggtcgtccgtgaatacgatcttcaggggtttggcatcagcgtgcagatctgccgacctctcgggaaccaggctcgtatgcacccactccaggacgtgcactcctacgctgctggggccgcactccactttgggttctaagtgagtgtttgaactgcggctggctctgttcgcgggtctgggcggcagccagtgatcactcggatgcagggggctcacgactcctgacagcaccttgcgccgtggatcgcgccaggtgatctattcgctgtgcaccggcgagaagcgtccgtagggttccgccatgaccgtcgagagcgagcgtgcagtgcaagcagccatggatgccgaaatgcggctccttgatcctgaggtgcgtgcctctccagcccgtgtgttggagcttctggatccggagttcactgagttcggcgcgtcgggacgccggtgggacgtgaactccatcctcacggtcacgagcggcggaacggtgtcatcggagtctttggtgcaggtcagcgagatgtccgggatcgttcttgctcccggcgtcgttcatctgacgtacttcgccgacaaccaggggcgtcgggcctggcgaagctccttgtggcgtctgacggacacgggctggcgcatgtacttccaccaggcgactcctgttgcgtccgaggctgagtaggcatgcaggtcaccggcggcgacggtgtgcggatcgccttcgagaccgactggagcgtcagggcccccttccagcatggatgcgtgcagcgatgctgacagccgacccgcatgcgctggcagcgctgaccgtcgccctcgccggccgcgacggcgtcctgggcaagctcgctcagacagcagggccagtactgctgctcgcgggtgaccgtgacccccagctcaaggcgattcaggacaccgctgatcagatctcgggcgccacctgcgtcgaactgcctgactgcgggcacttcgagacgttcctgcgaatcgatctcaccttgccggtcatccgtccatttctcgcgaggtgcgcggctggttgagagtggtcggtccgggcttcctcatcgggccggtcttcttccagccgtcggggtggcccttgcgtgtcagcctcctgctcatgagggtgatgagcgaccagttcaggtgagcttcgctggccggtgggcgctgatcgcgccgctgctgccgccctggcccgagaagctcccggcccgcggccggtgccggaccggctgtgccggcgggcatcctttacgcgctgcacaacgacatcgcctggcaactgctgccactggagctggggttcggctcgggcccgacctgctggcggcggctggagcggtggccgccgcggccgtgggagccatcatcggggccccgggcacggaagcgccgtgaccggggccccaggatcagctaccgcggaaggtgccgaccgccgctagttcctgtaccggaacacgatccggccgcgcgtcaggtcgtacggcgggagctccaccagcacccggtcttccagcatgatcttgatgtagttcttgcggatcttcccgctgatgtgcgcgagcacctggtggccgttctcgagctccacggtgaacatggcgctgcgcaggcactcgacgaccttgccctcgacttcgatgacgttcttgttcttcgtcatcgcaccagctccaggttgctgctcatcggccgggcgccgatgtcctcgaacagtgcagaggctgcttggttggactcgtggacttcggtccaggccgcggcgaacccggagcggtgcagcgtccccagtgccgtgggccagcagcgcccgtgcgatgcctcggcgctgctcgccggcccggaccgcgaccagcccgatgcgcggccggctcaccgtcaccacccggatcagacccaggtagcggtccggcgccgcggccaccgcgtacttcgacgggtcgacgatggtgtcgccttcggggcggggaatgacctccgcgggcatcgactgccacccgacggtcgcctcgacttcgtcacggatcgcgcggtccaccgcccgcagcagactctcgtccgcctgaccggcgggcacgatcgtcacgcccgacggcagcaggactgcttcgagccctgtgacccgcgggtcggtcggcacgacgtactcccactcacggcgccggatcgtgaacccggcccgccgccagccggccgtcagctcgacgtcggattcgtcgaccaccgtgtacagcggcgccggcagttccgccagcatcgcctcggcaagccggtcgaaggcggcgtcgtgccaggcatcgatactgacgaacaagcgtccgtcggcccggtgctccgcatgcccgcggccgaccaccaggtcgtcatccagtgcatgccattgcctgtccgcgacgcgcgtgatcaccaccgcgttctcgctcaggccagatgtgaaaggcttcgtgttcatcggagtctcccttccaggagtgcctagatctcaggcgctcctggcgacaccgaacgtcagccgccggaccgtgacgggttgagggagcacccatgggtaactgtgttcacggggctcacctccatacgacgacttcacggtccaccacgaaagtagcagcagggcgccgcctcgctcaattcctttcctatgctcgtaacgcgatcatgatccggacttcttgaggcgtctccagcagatgaggcggcaagccaacgagaggaagaggtcgtggagttcgagatgtcgttgacgttggcagcggtcgtgatgacgtgcagcggggtgtctttgccgtcgcagatccggtggtacttgctgcccgtccgggcgccgccagcaggtctgcccgacccgaacccagctccagctccagctccagctccagctccagcgggaggagttgccaggcgatgtcctggtgcagggcgtacaggaagccctgcagacagagccgatcatccactggcctcggccccgacgaccgcttcggccagggcggcagcagcggttcgatcagcgcccacaagtcatcgtccacgatccacggcggagtcgtcacacccgccgaacgatcagatcgtcacagcggccacgcccggccgggtacctcagcaagatcctgttacgagctcgtagttgccccttgcctacatggcggatccgaccaccggggtgaacggctcgggagcgtacgacccgcgatcagaactcgacgacaagccggaagagcgcggggtcggcgatggcgaagtcaggggaggtggacaggctctgttggaagcgggggtcgttgtctgctgtgcgccatgcgtcggggctgtcccagtgcgcgatgctgaccagctggaagcgagtgtccgggaccaccgcacggtgcagccggttgtcccggaagccgggcgccttggtcatgagctctgcgcggccgagccaatgcggcaggaattcatcgatccgctcggcgggcacctcgaaagcattgacgatggtgattcccggcccttcgcccgaaccgtttcccactgcgaggaattcggctgccacctcataccagccgccgttcacggtggcgtagctggccgcagtggctgccgacgcggtgaatccgggatccgccagcgcctcgtcccgggcttcgatgctgtcccagtgcgccacattgaccaggccgagccgggactccgggaacagtctgcggtgcagccgcgcatcccggaaaccgggggcggcatggatgagcccgacgcgctcccgccagcgtgcgatggactcgtcgatgcggtcctcgggcagttcccacgcgtcgatcagggtgattccgttatcggtcaccgcaccatcgtgaaacctcaaccagacttcaggtcaagatgatctgcacatcggcgccgtagtcggaggcctggcggtgcgggtctgccccagacccaggggctggcacgggagttcagcttgctggtcgcctgggtggtggcttgttcgatgtcgtcgcggttggcaaatgaccgcccggcgagggcagctttcgcggaagatacgccaccagccttcctacaggttgagccagcacgcgccgacagggatggaggcgtggtggaagcgggacggtcctcgcgtcaggaccggggtggacagtgccttccgcctcgttcgaaccttcgggcgccacagcccatcggcggttcaccacggcaggcgacgtcgtaggccgggcaaagccccatgccgacaaggggtacggctatgaccacctgcggcgatggatacgcagccggggcatcacacctcgaatcgctcgcaaggggacaggctccagccaacggctcggtcggcaccgctggaccatcgaacacaccatggcctggctcgccggatgccgaggcctccaccgacgctacgaacgcaaagccagccacttcctggccttcaccagtatcgcctgcaccctcctgctaccgcagactcgccgaatgagatgacgtggtaagggagttgcacggttcgtggctcttccgatgggtcaccagtgacagattccagcgacgcaccggctcgctgaacaggcatggaaacggcgagcctacgagcggctccgccccctaggtttcaccccatggcctcatccgccggtccggaagaccgcgataccgaggcgcggtcgcgtccggcgacccgcccgctgctgttgcgcattgttacggtcgtcggctcctcggcgagcttctatctgctgctgtcggtcgtccctgcgtacgcgcagagcgcacccggcgggggcagcgacaaggcgggcctggtcaccggtgcgctgatgctggccacggtggccggcgagctgacagccccatggctggccgcacgctgtggctttcgcgtgatgctgggggcggggttgttgttgctgggtgctccggcactggccctgaccgtgtcgcagagtatgccgtgcatcgtggcggtgtgccttgtccgggggctcggcttcgcgttcaccctggtggcgggtggggcgctgacggcgtcgctgatcccgcccgaactccgcggggaggggctggccctgatcggcgtgatggccggtgtgccgtcgctggtgggcctgccgctcggggcctggctggcattgcacacggaatacgggcccgtctgctcggtggcggcactgatcgccctggtctccatcgccgccgtcccgggcctgcccggccgggaagcgacgtcggctggcagcaggtacctcgtcgcaggacgagtgaactcactggctggtgttgattttgctggccatacggagcagtccaacgggttgagggctgtgatcttggccaaggtaagagcatggtcgacagcagtgacgcgacgacgacgtcccggaggagtcgtttcgacgccgtgcacaaatgggctgctacagccgccggtgtagtcgccctagccctttcactgtacaacttcgctgaacttcaaaagacacccaaaatcgatctgacacttcctcatctcatgcgcattgggctggcaggcaaggacacccatttctatcttcagccgacagtgtccaccaaagtcaagacccaggatgtcgagctcatccgtgacgcacgtttccaactgacccccgtcggctcgatttcctcttcgaaaaggccggttttctactggaaagaggtcggcacatggaattttaacctcgctaccgaatggctctcgtacaaatggtctggtgatcccgccccattccttgtcagtcaggacaaacctcagcagccgattttcttgttccaggccgacggctggagcttccagcccggccggtacgaggcatcgcttcagttgagccgatcagggaatcacagcccactgatcaagaatttctgcctgcttatttcgaagaaagccgttgatgaaatccgcggcggagcaagtcgggaggacatctttttttggcgcaatgacatgcccaaggccatggcctccaacgaatattcaggctgctacgtaagggaagcggagtggcggggccaggccggctgattggggatcgcgtcagtgggagacggagccgtctgacagacagaggcggcgggcggctggtagctgaaaccgctgtcggcgccggccagctggttcggttcccggggcggcgctcaaaagcatggtcggcggcggggccgccgacgagcagcgtgcacgcatcgtctgttggctcacacgccactcacacgcgatcagcgcgcaacaatgagaaagtgcgggacccagtgagactggatcccactcttcgcgttaggcatctatgctggtccaccgcgtgatcatgctggttgaggcgacgtacccccgacgggattcgaatccgcgcacacgactccggagtgatcgtgccgattgaggcacccactacgcctgacctgcaggggagttcgcagatgccctcgtcagccgagccctgaatgcctgtgcgtttcagcctcaccctgcttttccagggctgtcctcacccgtggatccttcgcccactcggcaggcagcttggtggtgcgatccagccgcgcacgcaagagcattggcacgtcaactcgggttgcatggccgggcaagttacggaggtccgcgccgcggaggtctgcgccggtcaggtccgcctggtacaaggtcgagccgcgcagaatggcgtcgcgcaactgcgccccacgcaaggtggtttcgatcagcgacacgccgttcaggtttgcgtggttcaggttcgcgccttccatattgccccgaccacagcggcctgttcgctccttcacggttgacgaccggactggtcgtcggtcacgacgtgaggctgccctactccggcagggtgaccgcgcccagctcgatcagggcctccgcggttgccacgatggtgtccctgacgtccaggggctcccagccaaggatggaactggccttctcgtggctgatttcggggatcctgccccccaggacggcggcgtccttcagcgcgggctcggtcttcgcggcctcgcgtacctgatcgatggtcagttccgtcgcgggcagccggtcggccgcggcggggaattgctcgcgaaggatgttcgcgatcttgaacaggctcgacgatccgctgttggcgaggaatcgctcgcccgccgccgccgggtgcagcatcgcgcgcagatgcaggtccacgacgtcacgcacgtcgacgacgccaaagttccagaccggcacgacgggcatctcgccggccatgagggccttgatcagtccgatggatcctgagggccggtccacgagttgggggccgaagatgccggtggggttgacgaccgccagctcgatgcccccgttggtcttgacgtagtcccacgccgccgcctcggccagcaccttcgacttgtggtaggcgggcagtccgggggtgttcggatcggtccagttctcctccgtgtagtggtcgtcgggcgtcagggtgtatccgaccgcggcgaaggaggacgtcatcacgacccgggggatcccggcgctgcgggcggcggcgatcacccgcagcgcgccgtcgcgggcggggaggatgacctcgtcctccgtctcgggaggagtgggcgggaagggcgacgcgtggtgcaggacgtgcgcgatcccgtccatggcctgcgcccagccgtcgtcggcgctgaggtccgcgaccgcgaactccagcaggtccgcccgatcgaccccggcctgccggagtgccgccagcacctgcgcctcctgtgcgggaccccggactgccactcggatgcgatgcccctcgcgcagcaggcggacgaccgtgtgggcgccgacgaatccgctgccgccggtgaccaggaccttctcgtcttcggggaatgagaggtcttctgtgctcattgcgttcagtccttcacagtggagtggtgcccgcgccggagggctgttggttcagcctggcctgtcgggcgtcagagggttgttctaggggtccggctccgcttcggtggacagccggcgcaccacggcgaacagccatgggggcgcctgcgggctatcgacgcgggggcgaatcgctatccggaatccgttccggtaagagcaatctaaccggaatgcgttccggatgcaagtagggcaccgacgggccgcgacgcaaagcccgggtaggtacgaaacgaccccgcacccctggggccgacccccggccgttcgcccccgggcctgggctcaaggtccccaccccgggcgtaccatgcaagtggaatggattccgctttctaggggtgactgtgaccagaaccgagacgacgcagcgcagaccgcgcgcggacgggcagcgcaatcgcgcccgcatcctcgaggcggcactgcgcctgttcgtcgagcgaggtcccgacgcccccttcaccgagatcgccaagcaggccggcgtcggtgtcggcaccgtctaccgccacttcccggcacgcgaagacctcatcgaggcggcttaccgctcggaactggacgccgtgtgcgccgcggccgcggaactgctggagcaggcaccgccccaggacgccctgcggatctggatggaccgcttcgtcgactactgggccaccaagatcggactgacggaggcgatcggagccgtcgtggccgcgggcagggacccgttcgcgcagagccgcgggcgggtcgatgaagccgtcggcacgctgctggccgcaacctcggcggcgggggtcacacgtcccgaggtcgaacctgacgatgtggtggtgtccctcagcggtatcgccatggtcgcgcctgtgctccaggaccgcgatcaggtgagccgggtgctcgacctcctctatgagggaatccgcgcccggccctgagcggcatggatgaagatcggtgaggttcacggatcctcgctgccgtcgtcgtcctcgtccaggtcgggcgtgtccgggtcgcataggggccacagggcgccggcacccggggtcgaggcggcgaagcagtacccccttctccccgcgtcgatgccctgccctgcggccggcacgttcgcggaggtcttgacactctgggcgtcgagcacgcaggcgctcggttcgccgttccggccttcggccgggcgtaccaactgacgcaggatgcagatgagttggtcgaagatgccgttcttctgccacgcggcgaagtacccgtagacggtctcccacagcgcgaagtcgtgcggcaggtagcgccacgggatcccggtccggtcgacatacagcatggcgcccatgatccggcgcaggtcatgctggggcgggcgcccgatatccaggccgttaccccctgcgttcggcccgccaggcggtcagggcgagctctgtcaactcccagcgggcatcggacagatcactgggatacggacgctgtcgtgccatgtttcggtactaccgtcgagaacctcgtatcggcagggcgcaaaacgaagcccggcggtgcggcccggagtgggcaagatgcgggcctcgacaccgaagtccgacaggtgggtctcgccacggatgagcccgtccggttcgagcggctcggcggtttcgcgcaccctcgaggtgcgagcgaagtgccgcccgaacaggccgatgggcaggtacggctcactgccccggcccgcctggtagatgccgaggtcggcgatatggcaggcgatcggtgcgtcggtgagtcggccgagttccgcagcggagccgaggcggggaggtgtccatgggtgacgacgatcaggcgaacgtccttggggcccacgccgtgggcggcgacctggtcgtgaatgagccggccgctgctgggtgttccggcgtcgacgacgatcggttgcctgcccagcagcagataggcatggacggcgtgccgaccgaacacgggaaacggcaatgacctcggtcgcagacattgaggaactcctcaacaggcatgggggctgggccgccgggcgatgaggcggggacgcggtcggcccgcaacagacagggcatcccgcacagcatcctgaccattgatcagatgcccgctgagccctgggaggggcgggcggcctgtgcttcggtgcccaggccgcccgacgcgatcagctgaagaacgggtcgtccacggcgtgaacccagccgccgtccggctggcgtcggaggatctcggtggtggtggagaccaccggctccggtccgatcccggtgaggatggcgttgttcgacaccagggcgatgtcgtcgacctgtcggatctcgcgctgttcgagcttgaggcgggcaccgctgtcgaccatctgccgcatggcctcgcggatggcgtccgtgcccaccaggtgggttccgggagtggggacgaagtgggcgttcggctcgtagagcgacaccaagccctcgacgtcaccggcctccaggtactccatgaacaaggtccccacctgctggggtgtctcggcacggcgccgggcggtgacgccgaccggcttgtcgccccagccggccgcgtcgatcaggtcgtaccagttgggataggcgccgtagggcaggtggcggcgcagcaggtcgccgatgaagttcgtcggggacgccttgtggggcttggccacggcctgggtgatgatgaggtcgctgaacccgtgggccaggtcctgacgcggcagcagggcgtgcacttcgtcggcgaggccggccggaaggctctcacgctggattccgaggatgtcggtggcgatacccaagtgggccagcgccacctccgtgcccttccgcgaggcgatgccttccgaggtgtgcagagcgatggcgtcccaggcgacggcgatacgctcttcctcgactccgcgctcgcggaggaatgccgctgcgatgtcggcgccgtcgacctcgaaacgctggtcgccgttgctgccctcctcgctcagtcccaagtcgtgcaggacacagctgacgaacagcagttcgtcgtcgtagtcggtaccggcgcgcagaccctggttctgggcatgggcgcgggcgaagacgtagctgcggacgcagtgatcgtgaatgaaggcaggcgtggcctgtgccgcaaaggcgaatgtgtcccgggtgaggctcgtgtcggggaggtcgagctgctcgaagacggacaggtctgcggcggtggtcatgatgtgtctccttctctgggccccggtccggggcagatcggcacggtggccgggcggaacgctcacgcgtgccgggtatggggggtgcggctgcacgggacatggagtgacagccgatcgccacacgggggatgtgcggctggagtgctgcgcttacagctgggcgacgaacgcgccgatgtgcgcggccacctggtcaggcacctcaaggggcgagaggtggccggtgtccttcaggacggtcagcgtggcggtcgggatcagcggcagcaggtggtcggcgagcacggtcggcgggtcgaccttgtcgtggctgcccgcgagaaccagcaccggcacctcgatggctgagactccggccgacacgtcctggaccaggccacggcgcggccactcgagacgggcctcgtcgccgccgcgcagactgtcctcgaccacctgccggcgcagctcgggagtcagcccgccgcgggtcagcatcaggtcgatgctctgaagaaccgcctcctcgttgtcgtaggcgtgggaaaccgtctcctgcacctgctcggtcaccccgatcggcgcgggcggcgcgggcgccacgaggacgactcccctcagaccggcgggcttgcgtgcggccaggatctgggccaccttgccgcccatggagtgtccgaccagcacatagcgggagtatccgagcgcgtcgacgacgcgctgcgcgtcgtccgcgagctgctccaggtcatacggtcccggcacgctcgtggagccaccccatccacgctggtcgtaggccacgaagccctgcccgggatccagacgctgcagcaccgggatccaggtgcgccgtgagcctccccagtagtgcaggaagatcagcgccgggccgtcaccctcgcggacgtgggcgtacacctggccgccctgcacgtcgaagaagcggcccaccacatgctgcgaagtcattgccggctcctcgtccacggccggggctctcggaccgctccaccggggtgtggagtcggctgccccgcgctcgctcttcgatcctgctccggaacctgccttccgggccacggctcatctgccagcatgcgcatcttttgggccagaactggtgcgggtgagccattgctttccggtcacacgatcagcggcttgatcaggagatttacctcgggaacagcccctgtggcggggcatggcggctccctggactccctgcgacattggtgccggacgtaatattgcggccatgaacaagcaccgggtcatggtcctggcggtcgacggcgtgctgcccatggatctgggcatccccacgcagatcttcaacgcccgtccgaacaccccctacgagctcaccgtgtgcggcgacaccgaggagaccgtgaccacgagcgccggtttcaccctcggactgaccgctggtctggaggcgctcgccgaagcggacacgatcatcgtcccgggcttcgaggacttccggcgccctccgcgcccacgggtgagggccgctctcaagctcgccggccgcgccgggatacgcatcgcttccatctgcaccggcgccttcgccgtcgcctcggccggactgctcgacggccgcaccgtcaccacccattgggccagcgcggatgacctcgaagagctctacccccggctgcgcgtcgaccgcaacgtcctctacatcgacaacgacaccatcctgacctccgcgggatttacggccggcatcgacctgtgtctgcacctggtccgcaaagatctcggcgcagccgtcgcgaacgacatcgccagggacatcgtcgccgccccacaccgtgacggcgggcaagctcaatacatcaacaggagcctccccaccccccaggccaccacgctcgccaacacccgtgaatgggccctgctccacctcgaagaagacctcaccatcccccacctcgccggccatgccggcgtctccccacgcaccctgacccgcctatggcgccaggaaaccggcgtcagcccccgccaatggctcctgaccgcccgcagcaaccgcgcgcgagaactcctggagaccaccgacctccaggtggaacagatcgcagtccggtgcggcctcggcagcggcgccaacatgcgcgcccgattccgtgacgccctcggcgtcacacccacggcctatcgccgcaccttccagcaccaggctgcctgacggcgaaggccaaaccgggcggcacggcacctgggcctacggctccgacgcccacactcccgtcgacgccgcccgcctcctggcctggcctcgcctcgcctcgcaggatgccgaacgtcccggggactgggcccgcatcgagcgcacgtgccgcgatgggcacaccgccacttggcgggccgccgaggcacggctgggccggtggggcccggacgggaacgtccgcctggcggtggccaccgcccacccggccaccctgccggcgaaggcaacctggtatccggccaccgacctgccccgcccgggctccccacgcgtcaccgaatcgccctgcccgcccaccaccctcgccgagatcgagcggatctacgggctgcgacactgggtcgagcagagctacaaacaggtcgtctagcagagctgcaaacaggtcatggacgaactcggccgacccgacttccaggtccgttccgacatggcgatcgggcgccaccagaccctcgtcaactgcgggttcaggaccgcgcggacctgaacaccgccaagcagctctacgagcaggcccgcgccctataccggtagaccagccactgtcccggcgagtagcaggccctgcgcttcatcaaccagctcgacggtctcgccccgcctgcgggcccatgacggtgccggtctgtcgaacaggcctgggtgcaggtcttctgcgaagcgctgggaagcgctgggaagcgtcggacttctactacggattcggtcatgggcctgaccgggggaacttcaccgaagccttcttgatcgcctcgcggatgcggaagtacgtgccgcagcggcagacgttctcgatggcgtcgatgtcggcgtcggagggccgtggcgtccgtttcaggagggccaccgcggccatgatctggcccggctggcagaagccgcactgggcgacgtcgcagtcgagccaggcctgctgcacggggtgcaaccggttgccgtcggcgaggccctcgatggtggtgacctcgcggtccgcgcagtcggcgaccggcacgacacagggctgtatctcgccgccgtcgaggtggctggtgcaggcccggcagacgcccaccccgcagccgtacttgggcccggtgacgttcagcaggtcgcgcagcacccacagcaacggcatgtcggccggcgcctcgacggtgacccgctcgccgttgaggacgaaggaataggacggcatcggcaccttctcagaaatcgagggttcagaagtcgagggggaaacggcgcggcctggacccggtcgcccgggcgtaggcgttggcgacggcgccggccgcggccgggacgccgagctcgcccgccccgcccggcgcccgccgcgagggcatgatgtgggcctcgaagtggagcggggcgtgccgctggcgggcgtagcggaagtcggcgtagctgctctcgcggacggcgccccggtcgatgtgcagtccggcccgcagaacggtggagatgccgtcgaccgcggtgcccatgagctgtgcctcgagcccgctggggttcacggccgtgccgacgtcggccgccatcaccaccttggtcacccgggggttcttcgggtcggtggcgtcgatctcggcgagacaggccacgcaggagccgtactcctcgtggacggcgacgccctgggcctgcccggcgggcagggcccggccccactccccggcggcggcgaccttgtcgagcacggcgcgaacggccttgccgcgcagtgtcgttcgacggaaggcgaccgggtcctttccgagcgcccgggccacctcgtcgacgacgatctcctcggcggtgcgcgacgtcccggagctcacggagcgccagggcccgatcggtaccgccaggtcgaccgagccccagtccccggagatcgagccgaagttgtagaggccggagtggctgggcagcggccccgccgctcgtgcgaaggccgccggacgcacaccggcgctcaggccgtcgttcgtctcgctgaccgtggccacggagtgggcgaaggcgaccacccggccgccggcgtggctggcccgaatccggtggtggtctgccgggcgcatccgcccgtgccggatgtcgtcggcacggctccacatcagcttgaccggccggcccgccgccttcgagacgagggcggcttcgagtgcggcgtcatggttcagccggcggccgaacgagccgccggcccggaggacatggacccgtaccttcgacgcgggcaggccgatggcggaggcgattgagtcgcgggcgtccatcggggactgggaggcgaaccagagctcggcgctgtgcgcgcgtacgtccgcgacggcagtcagcacctccatcggggcgtggctgacgaaggcgaactcgaacttggcctccgtctgcgccgagccgcgcggcggggtgccgaacctgggaacggcagcctgcagccgggcgcggatctcggcgtcggagagcgcggcgagcgggccgggcacccaggtgatcttcagggcgtcccgggccttgaaggcgtggtgaaaggtgtccgcgacgacggccaccccgccggcgaccttgacgaccgcgcgtacgccgggcatcgcgcgggccgcccggtcgtcgagcgtccggaccctgccgccgagcgtcgggggccgtgccacgacggtcggtttcgccccggccacggcgaggtccccggcgtactgggcccgcccggtgacgatgtcccgggcgtcgatccggggagtcgggcggccgatcacccggtgtttcgacaccggtttcggcttgctggacacggcggggcgcccgacccgggcggcgctcgcggtcagcgaaccgaaggtggccgaccgtccgtcgggggcgatcacgcgggtgccctcggtacggaggaaccgtgcgggaatgtgccaccgccgggcggccgcggtcaccagcttggcccgcgccagggcggccagttcccgggccggaccgtagagcgaactgaccgaactcgacccgcccgtgtactggttgcccttcctgcgtgcctcggcgagcgggatagacacgtcgacgagccgagcgtccagctcctcggcgatcatcatggcgaccgccgtggtcacgccctgtccgacctcgagccgcggtagccgtacgacgaccttgttggcctcggtgacctccagcaccagcatctcgtcgtccgcgccggtgaccaggacgtccgaccgcgcccggacgctctcggcgccctccgcggccggggtgtcacagccgagcggggccgcgacggtcagcgtggacgccgcgagtgtgtagatcacgaacctgcgacgggacaactcaggtgccaacggacgctcctcgacaggcgtttcggcccttgcgacatgtttcgccgtgttgccgtgtcttgacaggctttacgcgatgtctcggcggagcgtttcgccatgtcttccgggccggttcgacgtgtaagaaggctgggggccggtgttggttgcctggccggcgccaaatgccgctgggggggcggcgtggggccgcgcttccaagcctcggcagtccccgtccccgccgcgcctgggccgtcccggtaccggcgcggtgctcaggcatcgggccgggcgcccaggcaaggctggacgtgggccggggtggccccggtgtcccagctcagacaccaggggatgagtaacccgccagtagcttcaacttcgctcgccgaccgcgatgagggcgttgacgcgattctcgtactcgcggcgggctttgcgctgggcggggacggcctgggcgccgtcgaggggttgggagcgagcgaggagctcgcggtgtatggacggggcggcgttcacacggagggtgtagccctggccgcgtcgtacggtcaccccgccggcgagggccgagcgctggtcgtcgggcaggtcggcttcgcggaggaagtcggcgaccttgccgggcatgtcgaggaggacgggcagctccggtgccgggacgtcctcggggccggtggtgtgctcgggcatgaggtcggcgacggcggtgcggatggcgccgcggctgaccccgtgctcccgggccagggcggcgatggactggccgtccaggtacgccgtccgtacggcgtccgccttctcggcggtgacggccggcggcggccgcccttgctgcctttggcctcggcggccctcagcccgtcgtaggtgagctcgcgctggaggtcgcactgcagctcgcctggcggcggcgagggtctgcaccatgaacttcacggtggacagcagctcccggtgcgcggggggcgggcggtgaggtccatggcggagaacgcgccgtcgtggatacgtagcgcgaggcggtcgcggtggaggacgtcgagcgtgtcgaggatgtggccggtgccgcgtacggggcggaacatctcggagatgtgcaccgtgtcgcccggccgcgcgtacgtgagcaggtcgccgaatttcgggcgctcaagcgggtggaggcggctgaaggtgccggcctcctcctcgaagacgaccgggtcctcgatcccggcctcggccaggacgcctcgcgggcccgcgaggcgcggcgttctcttcgaggaattcctggatcaggtggcgcaggacggcggggcgctccaggtgcacgtcgtggcctgcgccaggaacgctcgcggccgttgccaccggtagccgtcggagcatggtctcggactcctgcggagagatgatgccggactggcccaggacggtcaggaccgggcacgtgatccttgcccactcgtcccagaaggagcgttgggcgatctcggccagcgaggcgaccatgatctcccggtcgaagcagggccaccagccgtcgcgctcctccagcccggcagcccagccctcgccgaccaggccaccgccgaggaactcgacagcggactcccgtgacgggaacggtgtcggccaggcatcgagccatccgccgatctcggcctgcacgcgcgggttcggtccgccggggcctgcttcgacgaggacgagcgcgtgcgcgaggtgggggtgtgcggcagcggtgagcatggcggtgtggccgcccagggactgtcccaccagaacgggccggtgcagggcgagctggtcgaggacggcgacgacatcggcgacatacgcggcacggctcacttcgcgcgggaagcgctcgctggcgccgtggccgcgctgatcgacggcgataacccggtagcgggggctgagggccccggcgagggtgtcccattcgcctgcgtggccggccaggccgtgcaggaggacgacgggccgcccgcagccgccccagtcccggcaagacaggcggacgccgcccctcgtcacgatgcgctcgaaccaggtcgcacgagtctcctcgcagcgtcgtcggatgggcattcagaagcggaacatcgcggcgaaccgggcgagcagagcaggatcgccgtccacccgcaggctgccgtcggcaagcgcttcgtcgggggttttggtgccgctcatcagctcgcggaccgggtggccggacaggcgctcgatgacgaggtcgggtgcaggatgctcgccgatgccgacggcgagcacaccgtcggtgatctgcaggcggatggtgaactcgcccatgcggacctcgaagccgacagtgacgtgctgggccgctgcgggccggaaggcggtacggaaggacatggccaccgcttcggcggtgatggcttcgccggggcggggctcggtcattgtccgggcgccccagcggcccagcgcaatgagcgccggttcgaggtcccgcccgaagtcggtgagctcatagacgaccgcgcgctcggggtgcggcagcgcacgccgggtggccagacccgcctcttcgagttgcttcagacgcgtcgacaggatgttcgtggggatggccggcagccccttgcgcagatccgtgtagcgccggggcccgctgagcaggtcgcggacgatcagcatcgaccaccgttctccgaccagctccatcgcgcgggccaggccacagaactgcttgtactcccgagtcgccatgatgcagatcctaactcaggattccattgacaaagtcagcttgcaaaagacaagctcacttctcattcaggggggtgggcccatccggccgccgcccttgcccatgacaggaaggattggttccacatgtccaagacgctccctccagccgctcgcggcatgaccccggcccgcgcggcgcccgggctcctggcggctgccggcatcacggcaggcccactcttccttgcagcgggcctggcccagggcctgacgcgcgacgggttcgacttcacccgcaacgccctcagccagctcagcctcggcgccttcggctggatccagatcaccgtcttcttcctcaccggcctgctggtcatcggcggcgcgatcgcgatacgccaggagctacgtgatggtcccggcggcacctgggcgccccgcctgctcggcgcgttcggtgcctccttcctgctcgccggggtcttccgcgccgacccgggggccgggtttcccgccggcgcccctgtgggccgagtcacctcgctgagcgcacacggcaccgtccatatgctggccggcgcgggtggctatctcgcgctgtgcgccgcgttgctcgtactcgcccggcacttcaccgcgcgccggcagccaggctgggccatgctcgcccgcctcgtgccggtcggggtcctcgccggattcgccgcctccgccaccaccgtcgcggccttcaccgccggagcaggtctcggcctgctcggcttcagcgccgtcaccgcccgcctgactctccccgcagagcgggagcagccctgctcagccgcccggagcaaccgcaccacgcccatcaccgcacgacaggagacctccgcatgaccacaccggcaaagggcccggtcagctacttccccgcgatcgaaaagaagtacggccgccccatagcggagtggaaggacatcatccgcacctcgccgctgaccaagcacatggaactcgtcgcctggctcaaggccgagcacggcctgggccacgggcatgccaacgcactggtcgcacacacattggccgaaggcagcaggtgagccttcgatgtgtcgcgttgggggcgcgtgcggcgtagccgcgcatcaggtcgagggcccaccaggcggcctccggggccggtgagtcggcgaagtccctcatcgtgtctccgcgcccgatcggtcgccggcgcccgcctgggttcggggccggggcaacgtgagccccaggtcgattcgtttgtccatgtccaggcggaaggttccgtacgggttgacgttcgaccagaacagtgcagtcaggccgcgccggtcctcatcggtgagcttcttcgcccaggccggctcggccaggacctgctgcaccagcagggtgtgacgtgcacgagtgcggaccgcacagcaggtgcagggcgagcatcgaggtctcggcgtgctccttgtccggcccggtcagcgcgccgtccttgccgtagtggagcaccgtgttggcgctgttccagttctccacgacctgcagcccgccgtggatctcgcggcgcaggtcggggctagcgaggtagtcgcaggcgaagatcgtgcgcacggcgcggccgagctcttccagagcggcgtaggtggggtgcttgggtccgccgcgggtgaagcgccgcagcacctgctccgcctccgccgtgcccagccggagcgcggtggcgtacttgaccatctggtcgtactgctgggcgatcgggtcccacttgatggggcgggtgagagaggcgccgagggccggccagccgggcgggctgtcgtccgggcggtacaggcggatgctgcccatgttcttcaaacggggcagcagccggaagttcagcagctcggtgagagcgaagccgaccacgctggcgccgtgggtgtcgacgtagttggcttcgatctcggcgtcggtgcagtgccgcagcaggccctcgatcatcgccgcgacctcggacgacgaacagctcttgagcttggagtagatgcagacgttcttcttctcgacgtgccagtagatcatcacgccgttgccgccatagcgggcgtggtactcagtcatgaagttcgaagaccaggacccgaacttcttcgagtccgacgcgcacgccgtcccctgcccccaccaggcggcatcacgggcggcgaaggtggcgttcaccaacttcctcaccgcggcgcgcaggttgtcgacggtgatgaagtaccggcgcacgtgccgcagcgcagccttcagcatcagacagaagcccagccgggtcggcccggacttgttcgccaccaagtcccggtcgccttccaccaacgtccagcacgccaccacgtcttccagcgaccactcctgtcgcacgcccgccccttcgccgtcgaccttccaggcgctcacccagaccgctcaacgagctgcccggcgcccggcaacggcgaatccgggcctcagacacctaccggcgggttacttgtcccctggtgtctgagctaggacaccggggccctgaccctcgccttcccggacatcgccgcggcggcggcttccgctctgggcaaggccctcgtcctggacggcgagctcgtcgtgcacggcggccgactggacttcccccaactccagaaccgcgcgccgccgggggcccagtgccgcccaggccgccgcacgcagtccggcctacctgatcgtcttcgacctccttgaggccgacggcagctggccagggccttccaccgtcttgccttcctgcctcgtccggtcgattgagcacgagcgtgccctaccaccacgaccgaaagacctcggagaccacgaccaccgcgccggcccttgtcgtgccccacacccaacggagcccaggccacccagcggctgacgatctactacatcccgtaggcggcaactgaaacaccgaggctgatttccggcacccactgtcgcggtcttgtcaagccgaagagggcatgcggtactccaaatgggcgaaggcgagatgcccacatggatagcagatgatttgcccgttggatggtggcaaggtggttgtgagccttccatgacccgattcgcagcaaaattggatctcgctcaggaatggccgggaccgactgccgctcgggcagattcgaggggcctgagggtgaagggtcatcacgacaccaccccgccctcccggcagacgacctgacacagatcgcgataatccggaagtcccgaagggcggctacggccgtatgcccagaccttacggaggcgacacatgtccgagaaccactgggaaaaccagcccggcaccccgccggatgtcacccccgaatgcggccaggaaagtgacggtgaaaggctctacctctggaggcagatcgttcattggcgatcggggactggcggcagccaatgcaatccccttatagagttggacaagcaaaatcactggtccgtgatgaacggcggggcgactggcgcgagcggttggctactggtccccacagaccgcaaaaagggaatagagtgccgcgacatctggacgcaccgtgatccgaactactggaatgctgcatggggatacgtaagaagtccctacgggagccccaccaccaccggcttggggatcaactcgaaagacaaacgcacacaggatcagctgcacatccacatcgccaccttccagtcggacgcaaagacgtacctcgatgcaagatcgccgagcgaaatcgccaccacgccaggcgattgggcgaaaaaactcctgacggtgcccagcgactcgaagccgggacaagtctatcgcgtcctccatgtcaaggacctcgccactgacaacctcttcaacctcctgcagagcaatgtggtctcgtccgatcaaatgggaaaccaaacaatgatcgtgattccggcgaagtcgggtggattctacgtgctcaatagtgacatcagtctctcccaaggcgcagccttcggcacaggcacctgcaaccacctcctcaaatgcagctgactggctctgttctattgatccgaagcgctttgttttcacgctcgttgacggtgtgcgagtgatctggtggaggatgcgcggacctggtcaccggacgcgcaggaggctgtgcgtttgctggcggtatccgcactgatggagggccggggccggtcggaggttgccgccctgtacagagtgtcggtcaggaccgtggacaagtggtgggcgaggtgacaggcgggtggccgggacgcactgctgtcccgtccgcggggccggcgtgcgggtgatcatcaggtcctgtccgaggccgagcaggccggtgttcgacaggccgtcctcgaccacgctccttccgacctgggtctttccggtcagctgtggacgcggaggctggtgggcgagccgatcttcaagctgtacagggtccgcttcaccgagccgggggtgggcaagtacctcatgcggtgggggctgacgttcccgcggccggacaagcgggcgatccagcaggatccggaggcggtccggatctggcgcgaggagacgtggcgggcgatcccggcccgggcgaaggctgagaacggggtagtgctgttcgccgaccaggtcggcatccggtcggaccaggtcgaactgcacttcctgccctcgtactcacccgacctgaacccagacgagctcgtcgacgccgacctcaagcgcagcctgccccacactcaccgggccaggaaccagaccgaactcgcctccgaaacccgccggttctttcaccgccgacagcaccaacctcacatcgtgcgcggatacttctgcggtcggcacgtcggctacgtcatcgacgagtgaaccccagcagtttctgagcaactacgctcacaccagccgcacaacccgtgtccaggattcggggtcaaggtaggcggcgagtcctgcgaggtgccggcgaccgtgtgttcgccctatagtccctcggctccgggatcgtgtgcgtgatacggcgtcttcgcgcagacagcgcccgttgtacgccttgtcaccgctgacgtgaccgggtcgggtgcggggctgctcggcctgcgggcggacactgcagctctcgaataccgacactccaccagtgcacccagatcacgtccgaagcggtgatcggcggtgtcaccgggtccctgaagaatccgctcaccctcctgctgagccgctatgacgatgccggtgtcctgcgtctggtcgccccgcaccactccgctgaacaccgcggtccggcgcgacctgggccggcggctggcgcccgccggaccggaacgcccttggcatgggaggcacttcagcgccgggtggggaacccgcggcgaactggagtacgccccgtccggccagacccggtcgtcgatttcgtcgccgacaccgccatcgacgcaggactccgccgtggcacccgggccgcttcctacgtctgcgcgacgacctcacgccgcaggagacgccgcccttcaccacctgaccaccgctcccagggaactcgccgtacggtggaacggcggcgctcgatcaggacgcgtcccatgaacccgcagagtgcgagggccactcgcagaatctgcgagtgatcgcaggaatctcacgctcacgtgggacgccccgaacacgggtctcctgcctgctgacttcgcccgaccacgccgctgctgcacgcccaggaacccgtgcgtactccagttgggggcgttacgtcctgccaggccgagcagtagcagtcaccgaagggacctgggcggtggcggtccgggtccctcgttgcggacatgcggccgctgctgcggctgtcagagagtaaggagccggaccagcaacaccgtcaacgtggccgctgtgagcagcgctcccaagatggtgaacgtccggtcgactatcgctgagtcccagccttggatttcgaatcggcggggattctccggatcgtagcggaccacgacgagggcgcccacgccgaagcggccgccgatggagccgcggccgaacctggacgagtgctcgcactcgaggccgtcgggggtcgtccaggcggcgaccggatggtggtacctggcaccgtcatcatctcgtctgacgtcgtggcggacgatccgtcccggtgcggtgacaccggtgcgccgcagggccttggcgcggcggagtccgtaaacgccgaagctgaggaagaccacgccgatcgtcagcgggatgagcgagaaaagccattcgcgttgcatgtgttgtccgacgcgtgcgcgggagtgttggttgccctggggcagttgtgaccagcgctgttccccagtcccagtcggccctgggcagggaccggtcgatggaccggaccgcacagtcaggcagtcagctccgtctggacccccgccgcagcaaaagggtcgtggcggatgaaccactcggtagcgaacaaccgctcccgcacatccgccggaagaccggcgaccagccccggcagggctccccgctccacctcggtgcgatgcgccagtacggcagcgatcttctgctccatccaagggccgacatcaacagtcgcggtgacctgtccatccggaacgctgtacaccgccttacgcgcaccgatcacgtctctcagcgccggcacggccgagtgcgggtgcgttgccaggtagagggcatgcggctgccagggggcaccgtcatccgggtacagccgctcaagtccggctgcttgggcggcgagtacggtcacccgatgggtgtgcacgtgatcggggtgaccgggcagcccgccgtaggcgtcatgggtgaccacgtcgtccgggggggaattcccggatgtgcgcgaccaaccgacgcaccgcctcgtcgagcggcgcatcgcacaaccgcacccagcccggtgccgagtgccgtacacgcgcatcggcgtagccgagcatccgcggcttgccggctccgaggatccgcagcgcctcggccaactccgctgcccgctgggtgtccgcggcccaggtcgccgtgacaactgcggtgcgcgcgcccgcagctgcgtgacgggcgagcactccgccggccgacaacgactcgtcgtccgggtgtgacggggatcacgttggcgggaaaacctgcggcccggctcgggcgtctagccggtgtgagatcagtcaggaaggcaccgcgcgagctggacgaggagcgtctcgtccggttggtggccaggggtgaccgcgcggcgttcgaggagttgtaccggcgtaccgcgccgtggatggcgttgcggctgcgccgtcgctgcgccgacgagcagatcgtcgccgaggtcatgcaggagacgtatctggcggtgtggcgcgcggcgggcgcgttcgcggggtcctcggcgggcgggacggccgccggatggctgtggacgatcgcggcacgccgcctcgtggacgccttccggcgcagggcccaccacgccgagccgccggtcgccgccgctctccccgacgcggcgcccgccgccgaggaggaggcactcgcaacggccgtcggcggtgacgtcggcgacgcgctgcggcgcctcgcgccggaactcagacaggtactgcaggccatggtgctcgacgggctgtccgtccgggagaccgcggtcctgctcgggctgcccgagggcacggtcaagacccgtgcccgccgggcccggatcgcgatgcgggaggcgctggcatgagcgtggaacacgcgtcgatgcggatcatcgacggttacgcacgcggcgacacggacatcgccgccgacgaggtgtgggccctggaggcccatctggaggcgtgcggggtgtgccgtgaccggctgtcggccgccgtcacagccgaggcgcccgccgtggcggcgctggtcggcaccgtgtggtccggcctcgaaccccagttggcagccaccgccacgatgccgcgccaacggcgctggtcggcgcggctgtcgaggtggatgacgcccacgatgatgccgtggctggccatggtcgtgagcgtgacactgctcgcgctcctgctcgacctggtcgacaccggcttcggcgaggtgtcgctggtgctgctgctcgccccgatcctgcccgtcctcggcgtcgccgcgtcgtggtcgcgcggcctggacccggcgtacgaactgacggcctccgcaccgagggcgggactgtacctggtgctgcggcgcaccgcgtcggtgctcgccgtggtcgtccccgtgctgctggtggccggatgggtgaccggcgtgacggccgcgcagtggctgctgccctgtctggccttcacttcgacgaccctggcgctcggcggcgtcgtcggcgtgacccgcgccgctgtctcactggcggccgtgtgggccgccgcggtcgtggcgccgaccctggccaccagccgtacgaccttcgccctgcagacgggcagcctgcccgtgtggggactggtcctcgcactcggtaccgctgtcgtgatcgctcgcaggggcgcgtactccgtgctgggagcacatcgatgaccatcggaaaggaacaccacatgatgtccgcggtaagcgcggccggcatcgcaccaacggcctacgcctggcagatccaggccaccgggctgaaggtcagggtcggcaggaagcggatggccgtcaacggggtcgacctgtcgctgggtaccggcgtacacggcctcctcggccccaacggggcgggcaagaccaccctcatccggacgctggccacagtattgcgccccaccgagggcaccctggagatgctcggcgagtccgcgggcggcatgggcgagcaccgtgcgctgcgccgccggatcggctacctgccgcaggagttcggctactacaagcgcttcacggtgcgtgagttcgtcgagtacatggcgtggctgaaggaggtgcccaaggcggacatccccgccgccgtgcagcgcgccgtggagagggtgggtctggcggaccgcgccgacgagaggatgaaggccttgtcgggcggcatggtgcgcagggtcggcatcgcccaggccatcgtcaacgacccgacgatcctgctgctggacgagccgacggccggcctggacccggcgcagcggctgcgcttccgcgagctgctgcaggagttgggtacggacacctgcgtactcgtgtcgacccatctggtggaggacgtcgccgccgcctgcaccaacgtggtgctcttcgccgaggggcgactggtcttccagggacctccggacgagctggcctcggtgggcggccccgagcacatgggtgacagcccgctggagcgcggctactcggcgatgttgctcaaccccgagcagggaaggggcacctggtgaacgtccgcgtcctgcgtatcgagctgaagcgctccgtcgccccgtgggccggcgccgtggtcctgacgacggcactggcgtttctgtacctgattcccggatcgtggtggacgggcaccacggcgtggacggcccagtggacgtccatggccctgtggacccgctccgtgctgttctacctgtggccgctcgccgtggggcttggggcgctgcagggcctgcgcgaccaccgctcgaagatgtccgagctgctgacgagtactccgcggcccgcccggcaccgcgcggccacgctggcgggcgcgacggcgctcacgctggcctcggcctttgcgctcctcgtcctcgtgggcgcggtccaggtggtcgccaacaccgagtacacgcacctcggatggttgccgatctcgctggtaggggcactctctctcgtcgcgggggccgtgctgggcatgggggccgggcgggccctgccatccgtgctcaccccgcccgcgctggccatgggcgccttcgtgttcacggtcctcctgcagacgtcgttgggccggacggagacgaccacggcgacggggctcccgagcacggagccgaaccgggtctccctgctgtcaccggcggtgcaggaggtgcgcgacgcactcgtcacgctctccgcctccgtgcacgtcgggcagacgatctggctgctcgccatggccgcgaccggcttcgcgctgctggtcgccgcgaccccgcgcgcccggctgctggccctgacgcccgtcctggcgggcgcggcgctcgctctgctcgtccttccctccgatccgcgccggatgtatgtcgtcgacgaggccgccgcggagttggtgtgcgacggcccggtgtgcgtgacgaagacgcagcaggcgcgactcgccgacctcgcgggtcctggtaaggaggtgctacgcctgctgcatggcgccctgggcagccaggcgccggtctcggtccgggagaacaccgccgtactgccagaaggctccacgccgcagtggtcccgcacgaccgtgctcttcgacttcgacgacgacctcatcgccgccgcgaagggcgaggagctgacccgggccctgatcgccaaaggcctggtgccagggtgcacccccgtgggctggagcggcttcgggagcgatgagttcgcgcagaccgtcgcggtgggctgggtcctcggggacctcaggccgcttcccggcacaccggcaagtctgcgccgcgaggtcaacgccaagacccgcccggtgtggaagaaactcaaggcgctgccgcgggccgagcagctctcgcggatcaacgcgatgcgcaccgccgcgctctcctgcaagggcgatgcgttcgacgcgctgaacggcggtgcgtcccggtgagatggctgacgctgtacgcgcgctcgcgtcagatacccgcgtcgctcgccgcggtggtgatcagcgcggtggcggtgtgggcactcgcccggaacggcagcggcgggcccggtgatccgcggctgcccgcgctcgccctcgctacggggacgatggcagcctcgatcgggctcagcgggcaggacctcgcgctggaccggacggccgcgatccgctgggtgccccgcagagcggcacatgtactgctctgcggtgcggtcgtcggcacggcgctgctgacagcgcaggcgatgggtgaggacatggccaccaccgcgttcgtcgtccgggacagcgcgggcctgatgggactggtcgccctgggcgcggcgctctcgggcggccggcacgcctggacgctgccgttcgcctggctctcgttctcgtttttcgccccgcccccgacgagtgtgccgatgcgggtggcgagctggatgctgctgccgcccggcacggcagcgggcacctggacggccctggtcctcgcggttgtcggcaccgcggcctacgccgtcgcgggaccgagacggtgacgaccgcagcgcggtcgcgtgcggcatgcgcacacatcggatcgagcacccaccacgcggcctcgttcactgcgcgggcaccgcgtgcgcgcgcctcggctcctggacggaggacacggtcaaggacatagccggcgatggtcgtcgccactccggccaaggggaagcggctcaccgacgcagtgggggcgcagaacatcgccttcagccgtccggccggtgagcgggtcaccgccttcggctgtccggcgaccactccccagcggggcgaggaactgctgtactgccccggcaactcccagcgcgcccccgagggcgagcagcgcgtcccgtgcgacctcggcggcggcgcgagcggcggtccctggctcgccggcttcaactccgccgccggcaagggcaccgtggtgtcggtcaacagcgacggcgagggcgacggcggcaccccgatgtacgggccgacgctcgacaagaccgcgcgggccgtctacgacgccgcccagcgcggctgagcgccgaggcttcggccggccggagcggcgggcccctggacccgggaggcggtcatgacgacttcgcggctcagcgcgtgcggggcggggagggctcatacgggcgcggagcagggcggcgcgggtacgttcggcacccttcctgtgttccccgttgaacagggcggtcaggtccttgggggcgttgtagtgctggtgcaggtccacggtggcaccgaggtcgtccaagagctggtcgacgacggccgcggcctcgccggcccggtcaccccagccgtcgccccaccacaggtgctcggtcggcgtgcacggcgcggaatggacgtggccgtcgctggtgatgattttgtcgggtcatatggaagccaccactccgttgggagcgagagccggcgttgggctattcgaggtggtgatgtactccctggccgtgcgacccgggtgatgccgaaaaggtgatccagcgcagcccgcgctcccatgtgagcggagctccccccacacacactgaaatcgtgattggaagacccgctgtactctcggccgggtgaagattgtgtcgcttgggttccgcacagatttgatgttgctaaagatgggtggagcagtggtcaccgaccacggaacgcacctggtggtacgcactccggcgaatcccggttttcactgggggaactttcttttgttcgaggttccgcctcagccaggtgacgcgccccgatggtcgacgttgttcgaggcggagtttccggagacgcagtaccgagcctttggtgtggacggcgtcgccggcctggtgggggacacggcagaacaccaagtgcttggagtgaccgccgaagtcaacacggtactgacggcggaccggctcgtgtcaccggtcgcggccccgcacgccgacgtccgtgtactgaccggcgacgatgattggcgccaggcgctcgaactgcacttcgcctgctacggactgccgtcgggcagcgacggtcggcacttcgccgagcgacgggtcgcgggctaccgcagtctgtgcgaggccggtcacggaagctggatcggcgccttcgtcgagggccgcctgcgtgccggagccggcctgttctccgatggctcggagctggcgcggttccagaacgtcgagacccatcctgacttccgtcgccgaggtctcgcttccgccgtcatccaccatgcggcccagcgcgcgctgctcgccccaggcatccgcaagctcgtcatcgttgcagaccccgacgaccacgccatccgcctctaccgggcgctcggcttcgtggacacggagcgacaggtccaactccacagggcaggctgactggtcacctcccccgacgcctccgacggacagtacgtctctcactactaggtccgggcgcacgatggataccgacgggcaggaccacctcccctgcccaggggcgcaagctgcccggcggggcagccgcccaccaccgtcagtcggccaggacctgctggactgcgagctggtcacggcgccgcagcagggcgtcgatgtcgccaccgatctgcccggcctccagcggttcgcccagcgcctcgaacgcgacctcgaggccgtcatcgcgggcctcgcccagccctggatcgccggtgtcgtcgaaggccatgtcaaccgggtcaagatgctcatgcgccacatgttcgggctcgcaggattcgatctttcccgcgatcgggtcctactggcgtgatgccggcggcggtcaggaccagaggcgcatgctcagtcaccaacgaaccagacgtatcgatgggagccttcctccgcagtccggcacaaggctcgcaccgcgtcaacccagggaccacctcgcgctgcgggcagacggtccaactcctcaaccagcatggggagctgccaggtgttgaagacggtatccgcgaacgggcagacaccggcgagcatggggaactgcgaccggtcgatctctgcgagcgactcgtcccaggcgacgccatgcccggacccagccagaacggtcccggactcgtgacgaacctgcaggttgatcatcgcgccaaactatcgctcggagagcccacggcccatccgatttggctgaagccaggttcagccggggtctcctcaggacgccaggcgcgcgtcacgcctgcgattgccgcctgcaccgcccgtacccccacggggtccgctgtcgggcctgaggcgccccggcaacaccttctgaagcgacatacggagcactgcacgcccagatcaacaagtcgtcacagtcagtgactagccatgcaggacgtgggccagagcccgccaaagctgacacagccgagtggtggcagccgcttgcgtaccctggcggcatgcgcatgcgtcccactctgagctggactcctcccgaggacttgccaccggctaccacggatgtggagccggtcgcccgtgcgctgagtaacggcggtgtgctggtgctcagcggggcgggtatctccacggactcgggcatccccgactaccggggcgagggcgggagcctgagccggcacaccccaatgacctatcaggacttcaccgccggcgtgcaggcccggcgccgctactgggcgcgcagccacctcggctggcgtactttcggccgcgcccgccccaacgccggacaccgggccgtggccgcattcgcgcgccacggcctgctctcgggtgtgatcacccagaacgtcgacggcctgcaccaggccgccggcagcgagagcgtcgtggaactccatggaagcctggagcgggtcgtctgcctttcctgcggcgccttcaccccacgccgcgaactcgccctgcggctggcggaggccaacgtgggattcgagccggttgccgccggaatcaacccggacggtgacgccgacctcaccgacgaacaggtcggggactttcgtgtggtgccctgcacggcctgcggcggcatcctcaaaccggacgtggtgttcttcggtgaagccgttccggcgcggcgggtccagcactgtcgcacgctggtcgatcaggcgacctcgttgctggtcctgggctcctcactgacggtgatgtccgggcttcggttcgtccgccaggcagctcaggccggaaagccggtactgatcatcaaccgggatgcgacgcggggcgacccgcacgccgtcactcgaatcgcgctcccgctgggaacggctctgaccaccgtggccggccggctggacattcccgccgacgacgaagcggcggcccagacaaggcagtgacagcaatgacacagccacgacgcccctcgtggatccgtttctgcacgcgaacagggcggcgtacgccaggagaagagggaaggccatgtccggatacggcttcgcccacgcgtccgatgaagttctcgccgtcaggaacgagctggcccaccatgtgatccaaccgctcccgtgtgccggtctgaccgccttccgcgatggggagaccgacacggaggagcgtccggcgccgtggtctacgtcgattccgatgccgagacggcttcggcggctgtgtccatggcatggcggggtgagcccggcgtggtccgggccgctccaccaacacacagccagagactcaaggcatggtcctgctccgggatgcgggtagcgtcggtgcgtatggactttgaactgatagaaggagcgcccgagttcgggtgtctgatcgccgaggtcgaggagaccggcgagcgcatccggctcaccgcggacggcgagccggcgggggtgctgctggcggcggccgagctggcgacactggagtactgggccgcacgtcacaacaagggcgcgcggccgcaggacgagccggcagacgagtacccgccggggccgacgtcgtacgggccttacatcggctacagccacccgcacggcgggatgaccctcacgcggggccggctggtcgtggcagagctgcgtgacgccgaaacggtggcgtggttggaagaacaggcgatgtatggccgtcaggggtacatggggccgaagcagtcagcagcattcgccgagttcctcgcccgtcagacgccggtcggcgacgagcactgaacgacgtaccgatcgggtggcactcgccgacgaggtgcggccggttgagcgatcggcacgggtcaatccagcagcatgaccggcgggacccactactcgacggccaggccgtcgtccctggccggctcgtcccgccaccgggcgagctcatgccgaacagccaaggtgtgggggtgtttcgggcccagtgtccgctcccccgccaccaggcaaggccccgcctcacggccaggtatggggatgatcggggcctagctcggcgcccgcacgcacgtgtgccgtggtcagcgacccggccgcatcgagctccaacaaccttgcaaccagcgccgaccggacaccctcaaccacgccgtggtctcaccccacgcgcccgactcccccaccccacaccctcctcccggcggaaccgacaccaacccactgacaccaaaccggcacatcgcacgcgaccgagcggtcaggatccccttcaacgagccgtacgcccgcggcttgcggatacacggctacgagctcatcgacgtgtgccgctcctgggatcgcgtgaacagctctcgcgccctggtgtgtggttggaggggctggtcagcgccggctcttgatctcgtccagcgtctgttcgaccgggcccgccaagacgtcgatcagaccgtagcggttccgcacctcgcggttcgtctgttcggagaatgtgcgaccttcctcacccaccggcacgatgaccggcgccacgtctacaccatgtagaccaaagcgccaataggtagtgacgcggcgcgattctctcgtataatgatcgatcgcattgttttcttgcatatcggccgtttggatgatggtgtcgttgtcctcctgccctgccttcacccaatggggcagctcgacgccccgccaggagtaaccaggccttccgaaatttcccataacgagccggtctttacgcgccaggctcagggtggcgtagaacgtcagcttgtcgaaatgcgtgtcgatgggaagctgaacaacggttcgcgtgagcgcctcatctttcgcctcgacccagtgtccggcgggaatccactgctgcgccgccaccagcttgccgggctggtagacctccctgcgggtgagcgggtgcttctcccggtatctggcccattgctcggcgccctcccgccacttcgagcggtccaggtccgtcgggctcaccgtcacgtcctctcccatggcgtggaactcggcgcccagcacatagaaactcacatcactgtggttcacgagcttgatgtcgaccggcacggagaacgccttgcggtccgcactgagcaccgccttgcccacgttcagctgcacgagcggggcgacctcgcgccggtgcggctgaaagagatactggtagctgaaattggcgaccgccacgatcgtggagacaatgagtgccgcagccacccgcttgggagtggggatctcatccagtcttcgccacacctggatgacagccaatagcgaacccacgctgagcacaatggacagtaccttgtagacgactctctcgccgtcattccatgtctgaaacgcgagcaagacgttcgtcaacaacgccacgccggtactgatcagcgcgaccactccaaagttggaaatcggccctcggatccaacagtccacgaccgcggcaacacccacgagcatgatgagggccgccaccatgagggccgctccggtgacgcaacccgggaaagtcagagcatccttgaagtccttgaggccgcaccagcccaccggcagcgccgtcaggagcaggaccagcgcaacccataccatttccgcctgcgcgcatttggatttcgtcaggccccgtcgcaccatcacgtgcgagccggagcgggaccctgagtcgggccctaaagaattcgtcacatgatctcctcctggcgacacaccggaatccgatcactatgctccgatgtgatccacgcggtcactatccgcattccgccggtcggctcaccagcctgcgcgaaagcagtatcgagcggccccgtctgacgtccgatgcttcggcgaaggcggtcgactgtgacgagtacgcgatggcctcgacacacgggtccggcggctaccccgaagagcgtgaacaaggtggcgtagggcaaggagtgcgcccagctgttcaccgacaaaatgggtgaaggttcggcgaacttcggcctcctggcggacacccgcacgacgaacgggccgagcggcacggaacggtgcgggcgtgccgcaatctcgagcaccgcagaaccagaaggcgttcagcggtttcccggtaccgaggtggcggctgctggacggcgacgggttcttcgccgccctccccggggttgagcactgcacatcaaccgcaaggctcgccgcctggctggacgagggaccggccgcacatggctggacggacgaccaggtgtggaccgcgtgcagatgcctggccggcccgccgctgagcgggacgacgacgcggtcaccgcgtggcgggaggcgacctgccaggaggtggaaccctccgggcggcgaccggtgcgttcatctgcttcgaggacgaagcgggtgtgaccggccggccgcccatgggccgcacctgggccggcgcggcatcacccccacggtgggcgtttcggggcgcagtcggggacggctgtcggtggccgggctcctgtgcgtcgagccgaacctgcccacccgcctccgctaccggctgcgccggcgtaccggccgcaaaggcgagcgccgctcgctcggcgagaacgactacatccgcctgctcgacggcgcccaccagctactgaagtctccacggcgactcaaagcgctgcagtaccagcacggcatcctcggcggcttcctcgccgggaccggtctcactctcgacagaccgaaccgacctaaaacgccgaagtcagtaacttgcctcgtcagcgtctggctgaggcgatctcagtgtctcagcgccctgtacgggcgcggcggcgatgacggtgtcgagcatcgtgcgggatgcctgcaactccttgatggcgcgggtgatccgctccctttcctgcgccagctgggcgaccaggtccgggcaggtgggcacgaggcgatcgtcgtccgtgcggatgcagggcagaacctgagcgatcagagaagtcgggagccctgccgccaggaggcagcggatacggcgcaccgtttccacgtccgactcgctgtagatgcggtagccgctcggtagccgcgccggtgccagaagcccttgctgctcgtagtagcgcagtagccgctcatggactccggtgtgccggaccatctccttcatgcgcacgtggcttgcctcccagtgccgcgacttgactctgacattgatgtcagagtttagcgtcggcggcatgaacactgagcactcgcttgccacgcctcacctcgacgttgtcgtgaagggcagcggccccgcactgctgcttgcccacggtgccggcggcggtatcgatggcaacttcggcctcgtcctcgacgatcttgcccgtgaccacacgctcatcggcccgcactacccgggggcgggcggctctcctttggcaaccgagcccttggacctggacgaactcgccgaccaactggtcgcctccgccgtcgcggcagggcaggagtcgttcgtcgtgctcggcgagtcgctgggcagcgccgtggccgtccggatcgcctcccggcatcccgagcgggtcagggcactcgtcctcaccgccgggttccctgtcgcggacccggtcctggcgctggccgcccagctcatcaagaccttggcaggggcgggccagtggcgcgacatggcccggctcgcctgcctttcgtgcctgtcgccgacggatctggcggacatcgcgccggccgacctcgatgcactggtgacccagaccctggccgggatgccgccggggacggtggaccacttcgacctggtgtcccgagtggatgtccgagcagacctcggacacctgtccgcccccacgctggtggtggcaccgaccggcgacaggctggtcctgccccagagctcgtatcgattggcggccggcatcacgggcgccaagctgatcgaactgcccggcgcggcccacatcctgaacgaggccgaccgcacgacgtggctgcgacacgtccgcgagtttctcggcactcttcccgcgaagtcggcatgaccgctgctggggcaccgttcaacggttgaagcggtgccccaatcccgcggagccttccgcgccccccggcaaccggcgaacgaccgcccgttcgtcctcatcttggccgtgcccgtaaaaccatcgcccagcaccccgccccgagcaaccgcaactaccctgccaccaggacatatacccaaccaaagaggcccccagcactagagtccgtcttcggttgtgatcaattggtctgcaggagactgccgatccagatggtggctgcgcggaggtggaatccggcgaggtagctctcgggcgtcttgtcatggcgggtagcgatgcctcgccagtccttcatcctgttgatggcccgctcgaccgtgttgcggtcgcggtagaagcatgacttccttgatacggcgtttacgcaggtgggagtggttggcgcgagaaaaataggctttgtcgccggtcacggcggcgggccgggtgcggggacggccggcgggcagacgggcccgaaccttcgccaggaccgggaggaccgtgaggaactgggggctgtcggcggcctggccggcagtcaggccagcgccatcggccgacagcgccggtcggcggccaggtagatctggaggtcagcccgccgcgggaccgtccgagcagggccgccttcagccgggcctgccgtctcgggttggtgcggtacttcttcctcgatgccgcggaccgggctgaaccgggacgccacacgctcctgcccgccccggctacaccaacacccccggtcacggaccgtgatcaccctgtcagctcctccaggctgccgtcgggcgccggggagggcagagtggggccgtggcgcgacccgacgagcgcacaggcgctggccgtatccctgcggccatcgggtcgttcccaccggccgacgcaggtcaggagaccgcccatggcagcaggagcgagcaacagcaccgcgaatgccgactggggcaaagccaacttcaacgacatctacaactgccccgacccccgcccgtacttcgcaaccctgcgatccctcgagtaccaaataccccaccatgggcaggccgtcttccgggcactgacctatgctctgcgctggctgcaccccgaccggacgccactgaacgtggtggacctgtgctgctcctacgggatcaacacagctctcctcaactgccgtgtcactctgtcggacctgtccacccggtacacctcccaccacctctccgccctgccaacccggcaactcgcggccgaggaccggaccttcttcgcagcgcgccgccgcccggaagccgcaacggcgacaggcatcgactcggcagccctggccgtcggatacgcccgcgccgtcggcctactcgaccacgccttcgcggagaacctcgaagtcaccgaaccgagccccgccctgcgccgcacactggcgggcacggacctcatcaccgtcacaggcggcgtcggctacgtcttcacccggaccttcacgaggcttctcgactgcatgccgaccccaccgtgggtcgcggcgttcgtgctgcgcaccgtgccctaccagccgatcgccgacctgctcgcacgctcgggcctggtgacggagaaactgtccgcccgtaccttccggcagcgccgctttgccgacagcgccgaacggtacgcggcgttccacgccctggctgtgaacggactgcacacggcagacaaggaagcggacggcttctaccacaccgacctgtatgtctcccggcccgctcccgacatcgcggcgctgcctctcgcacgcctgctgtaacccgaggcgcgtcggcgaaccgtcggtgcgtggctggaacaccggcgccgatgccggcccgccacctccgacccgccccctgctgatcaaccagaccgacaagcactcgtccacggccccgacccgctccacctcgccgaggtgttcggactcgacgagaagaaggcgaaggtgaaggtgaacggcaaggaggtcatcttccgcggcggcgaggccaccggagtgttccgcaagcggctccacgagatcccataggcgcaacgtgatcagccgttccatgctcccccgatcgcccaaccggcgtactgcccggcttccccgccaccagttgccttgacgtgcacagctctgggcgacctagctacgttcggttgggcgcgcggagggagactgtgcaacaactgtagtcggggcactccaccgcctggctgtggcgggaggcaccaacacccagatctacgttcgggtgatgttcacgatttcactgctggactccgagctggttcgcggcggcgtccacggtctgttcgagcaggacggcgatggtcatcggtcctacgccgccaggcaccggagtgatcagacgggcacgggtgagaacggcgtcgaagtccacgtcgccgacgttgcccgggttgtatccggcgtcgatcaccaccgcgccgggcttgatgtcctcaccgcggatgagccggggccgtcccacggccgctaccacgacgtccgcttcccggaccatcgccgataggtctgccgtgcgggagtggcagtaggtcaccgttgcgtccttggcgagcaggagcatccccaccggtttgccgagaatcgcgctgcgccccaccacgacggcgtgcttgccggcgaggtcgacgtcgtacgcctccagcagccgcatgattccgcccggggtgcaggatacgaagcccggcaggccaaagctcattgcggcgaaggaatgcatcgtgaccccgtcgacatctttcgccggggcgatggcctcgaacgccgcgcgctcatcgatgtgcgggccgcaaggatgctggagaaggatgccgtgcacctccggatcgccggacagcccagagagactgtcgatcagctcagcggtcgtggtggtagcaggcagagcgatgtgtcgagaccggatacctgcctttgcgcaccgtgcccgcttcatgcggacataagtgaccgatgcggggtcatctcccaccagcaccgtcgccagacagggggcagtacccgtgcgctgtgagatctcggccgctttggcagcagcctcttcgacgatgcgccgggcatggccggtgccgtccatgagctgggccgtctgagtcgcggacatggtcgtcctccaggcgttgctgaccactcgcccaggcgcacggcaacgacgtctcgtcagaccgctccccggtggtgctccacctcagcgccagtcacggcccacaccgcactgtagtagacgcagcatgcatactccgatcagtgcccttggctgggtgggccggcccacaccctctgcgctgacgtcaatcttgtgggcactcctgacgcgcctccacgccagacgccttctgaactcacacacaagatgctgctggaagcgaacgaagccagtcagcggttgacttcgaggttcgtcagaacaagcagggcacgcaggaggtgggtggcgcgggcggggccgctgcggagtctggtgacggaccgccagttcttgaggtgggcgatgccgtgttcgaccggtgcgcgtccagggtggggcggcaggtcagaggccgccggtgttgagcagccggttgggagtgtcggagcggacatcgcgcacgacaccacgggtggccgtgtggtcgagccagacgtggacctcgtgagcagtggcatgggggtgcgccgacaggtacagcgcgatcacgccggtcgcatgcggcgcggcccaggacgtcgcgccgtcgttctccgtggtcgtaccgccgccggcgagggcggcggtcaccttctggccgggggcgtacaggtccacgcaccggccgtaacccgatccgtaggagccgccgtcgctccacgcgcggtcgttcgaggtggaggccgccacgacgatcgtgccggggacgccggccggggagtgcttgcaggcgtcgtcatggaagttgccggccgacaccaccgtcgggatccccgcgtcgaccatcttcttcacggcggactccacggccgccgaccggtggtcgaagttgagcgacatgttcaccaccgccggcttctgcgcgtgcgcggtgacccacttgaccgacttgaccacggccgcctcggccgccgccggggaaccgccgccctcgctctcgcacaggatgccctggacccgtacgagctccgccttgggcgccaccccgtacctcgccccgccgataatgcccgcgacgaacgtgccgtggccgatgcccccctcgttgaagcagtcaccggagtccttcgggcccacgaagtcggcgccgaggcgggcgcgtccgccgaactccttgtgagcgatgtccatcccggtgtcgatcacatagacgtgaacgcccttgcccgtggcggtggtggtgaacttcccgttcagcggccgcgaccgctgatccagaatgtccagattccacggcacgtgccgggtgatgggcgacgccgcggtctgcgcgatcccggacaacttccccacggtgccgggagacgtcgaggccgagccggaggacgccccgtcccctgcgggcgccacgggctcccccttcccgtgcgcggggagcgtcccgccggtccccccggccgccgcgccggcttccccgccgcaggccgaggccccgagcatcgtcgccatggccaccgccagaagaccggccttcgttacgttccgcgtcacaacgtcccccacatccctgcttcgtacacagtcagcgcacaagacggccacagaggacgggtggttccggcggggcgtgggggtgagtcggttcacacgctgggcggaatcctgtccgaccgcgcaccagaaaagggcgccgccggacacgatcccggcggcgccgtgtcagcgtttgcgggacggcccttgccagggcttgcagatcatcaacacgtcgccttgatcttgttgtgggactctccggtttggacgaggacgcgagcgtgaagggccgcgaggatgagggctacttgttcctggccgagtacagcttccggtttcgcatcgaccgctggtgccggggacgcgtcttcctgctcggcgacgcggcccatctgcccggtcacgcgcggcatcgcgttgacgacagggctgagccatgagccgatgggcatcggccgtcagcccaccgtcagttccgtcagcggcagtgtgtgctgagtgcggaccaccttggtacggaggtagcggatgttgtgggccgtggtgaacacgcccgtgggaacgtgctgggtcaccgttaggcccagggtgcgcagctgggccgccttgtccggattgttggacagcaggtccagctcaaagatgcctagggcggcgagcatctgcgcggcggcggtgtagtcgcgggcgtcctcggggaggccgagggtcgtgttggcctcgtaggtgtcgaggccctggtcctggagggcgtaggcgtcgagcttgttgtagaggccgatgccgcgtccctcctggcggaggtagagcaggacgcctccgcggtcggcgatgcgctcgagcgcctcgcgcagctgggggccgcagtcgcagcgggccgagccgaagacgtcgccggtcaggcactcggagtgcaggcgcaccagcgggggccggccagcggcgggttcgccgaggatgacggccacgtgttcctgcccgtcggcgaggtggtggaaggtggcgaggtcggcggtcactgtacagccgtcgccgaagcggagtgggaccgtcacgcgggtgcgcaccgtggttgccgacaggcctgtcggattcctgctgtcactggatgcggtggcgttgcgtgagtcgcgcatgtcggtctgcttctctgggggggcggttgcgggtgttgggcgcgctatgggccggctccgtcgccggggcggcccatctcgctcggtcgactcgtcagggaacgaggatgaggcggatcggatcgccgatcttgttctccaggcggtggatcgcctcggggacgtcggccagggggatgtggtcggtgatggacggggccaggtcgagacggccgctgccggccaaccggatcagctcgtagacgtgatcgaacgaggatccgtagtgtccgaacaccttcttgttcttcaggttgaaggtcatcttctccgagatcttcagcggctcggtggtgatacccaccaggacgagcgcaccgtggttaccgaggagaggcgacgcctgctccctgacccggggaacgcccgcgaagtcgaaggcgtagtccaggcccaggccgtcggtggcccgcagcacggcttcgacgaaaccggggtcggacgggtcgagcgcgacatcggcgccgaacgcgagggctcgcgcacgcgcattgggcagcgggtcgacggcgatgatcggcgtggcacccatcatgcgggccagccggacggcatgggcgcccaccccgcccactccccagatgcccacggcctgggcggaacgcacctgcacggtgtcgaccagggccgcgtacgaggtggaaacggcgtcggggatgatcgccgcctggtcgaagggaagtgtgtcggggatggggacgacggtgtcctcacgggcgatcgtgtactgggaccagccaccgtcgtagtcgacgccgcggccgcggaacgatacgcacgtgccgccgctgacgcagcgggcgcactcgccgcagggctgtcctgcctgcagggcgacccgtgtgccgacggccaggtcccgcttgaggccgggtcccagggaatggatgacgccggagagttcgtgcccgagggtgagcacattggagttcaggtgcagcggcgtgatgcttccgtcgatgaggtggagatcggagaggcacacgcccgccgccttcacttcgatcagtacttcgcccggcccgggtacggggaccgggatctcctccatggcgaacttcttcgtgtccaggtggacgcgtcctgccagcatggtgtccatcgttttgggccttctcgggtagtggttactgatttggagtgctgcggcggtccgtgggaccacgagggggtgaggggggctgcgaggggttgaggggggtctcagccggtaagaggccgagtcgcgtttgcccctgcgggctggtacgggggcggccgaacggcatgccgatccgtccggccgaccccgccgtgccccatatcgccggcatcgccgctcggcggctatggggcagcctgtgcaacccggttctgggcaacccggttctgcgcgaggacagcgcgctggaacagggcatgggctcgggctgtctggcggaatgcgaggttctgcagcgccagttggagcccccgctcggcatcggcccccaccgtgagccagaagtcggccgcgtggtcggcgtaagcctccgggtgacgcagcaccagttcgccgtaacgcgccgccgcgcgctcgcgccactggttcgcctcctgaaacctgtcgcatgcgtgcaacgcggccgcgaggtggccggcgtactcggggtcgtcgctggcccaggtgaggggacgcaggagggcgacggcggcctgagggtcgtcgcgcagcagctcgacctcggccaggtggcccagtgccggcgcgtagtcgggcacccggcgccgggcggcctcgtagcacgagcgggccgcatcgagatcgccctcgcggtgccacatcacaccgcgtcggaagtccagctgggcgagcggaaacggtgaggtcccctgatagtggcgccgcgcctcgccgaacagccgctccgcctcgctgacctccccccgctcggcctggagtacggcgagcgcgccgagcgtcgtgaagtcactctgccgctccgccgctttgcggatcagggccatggcatccgcgtagcagccgagggcctgcagaacgacggctcgctccgcgtccaccgtggcctcctccgcgccgttccggcccgccgcgccgaggtcggcaacggcctcggcgaagcggtgcagggtcgcccgcgtcctggcgcgggcgagcagggccgtgccgtcctcgggagcgacgtgcacgagctgctcagcgagttccgcggcccgctcgtagtcggcgacgcggcccaggatgtggcctcggaggttgaggaggtcgatcagggccgccccttgcgccaccgccaacggagccgccgacgtctccccggtatccgcacggctgagccgtacggccaggccgtcgatctgcccgtgcagattcgttacggcgatggtgccgctcgtcgtgaccggctccctctcctggggaggcgccccggtcatgccgcttcctcgcggggaggcatctgcgcggccaggcgggcacccaggtccggcggggtcgggttgggagcgttcaggtaggggaagctgtgggtcgccggctgagtcggctggtcgacgccgtcgctgatgcgctcgccgtcgatgccacccaccagcagcgtgaagagggtgtccacgatgtcgtcgttgagtgaccggccaccgcaggtcgtgtgcgggcggccggcgagcagggcggtctcgatctcgaaacagccgtcctcggagaagggcttggacaggtcgacgacgaggaagtccgccagcagcagttcggtcagcgggtgggcaccctgctcgtccagcggccaagcggtcttgccgtccaggccgtcgtagaaggccaggttggcattgagtcgtgcgcggtaagtgctcgcatagtcgggccgcacgctgaaggcgtcctcctcgttgaagaggtcgcggatctccagatcgctgttgacggtgtcgaacttcttgggcgacatgatcacgtttttgatctccggccggcccatgcgctccagccgcaccgggcgtccaccggaagtcacggtctcgccgacgaccgccaccagcgagtcggcggccggaccgagcaccgcggcgtcgacttcgagcacgatgctcagcgcgttcaggccctccagaacgttgctggcatcagacctgaagcccagcttccccgtcgcctcggtgaccatcactcccacgaagtcgatgaagaacgggtcgagccgcgacccggcgaagatcttcagttcctcggcctcggtgggcacctcgttgccgacctggaaggcgatcttccggccgctgggcgcatggcacgtgcccatctgcagcagggtgtccgtgccgtcgaccttctggggggcgtcgaaggtgaagtcgaagacgtactcgtcctcgccgacattgaacgccgcatcggcactctcgctcccgggcgtgaccgggcggacgcggaaacgataggtgatcgcatcggagaacagggccgtaggggccgaggccgggaacgtgttgaggacgagcaccaggttccccggccgctccgggctggggaaggcatacacgtcggcgatgtcggacgcagggtcggcgatggcacgcggcccggagaagtggtcagccatgagaaacgctccttgtcgtgttgatcgtgagagatgtcaggtgtcgaggtcggcgatccagcgcagcgccgacagaccgggcatgaagcagtactcgccaccccggttgacgacgaacggcggcagccccttgaagcggcggcggatcggctggcgcgggacggtgaacccgccgtcgtcgttcacgccgatcagcgggtccctttccgcgggcgacccgatgaacttgccgtcgttcacccactgccgctggacgaactcgaactgccggtccaggtgcgctccgacaaaggcgaacatgatgccgcggtcggcgccgtcgtcctccagcactcccttgggcagcggcgggccataggtcgtaccgcgccggatcatgcggtgcagtcgcacctcaccggtgacgaccgcgtcccgcgggttcatccgccgggcgtgggagcccaccgggcacttgaggccctccgggtcgtcgccgtacatgaacgcgttgttccgcgcggggtcggcaccgagttcaggatcgtccttgtccggcgtcagcgccaagggggcgccactgggccagcggccgacgaacttggccgccagcagctcttcgtcagcggggtctttggcgcggtcgcggaggtactgacggaagtcggccactcgcgtgtgcagcttgcggaaggccacgtacgttccgttgcgcccgagcacctcgggctgcggaacgggtgtgatgccgtgggtctcgtccttgtatccggtgatgaactcgcctgccctgagcggctcttcgtacggattggtaccgggaatgcccgtgccctcgatcgccggctgaccgatgctgtcccggaaaccgaagggttccttctcgtccggtccgacgtgtacgtcctgctgccagatggcaacgacgccgggcagatcgcgcagggcgtcgcggaccaggaggaggaccgtctccaggcgggcggcatccggggcgagtccgccgaggacgaggtgcacgtccttcgaaccgagcgggccctcccagttctccggcgcgctctccccgatgtccccgatgtactccgcccgcgcggccatgccctcgcggaactcctccgggaaggtggccagcgactcctcaggcacccccaaggccttcaggccctggaagctgagtgccaccgcgagcgagacctgacgctcggggtcgaacgcggcgaccgagtcgagggcgggggtgagccgccgcagcagctcgcgcccctgccgccggtcgtcgatgcgcagggcgaggtaggcgcccgcgtatggcgtcggccgtggctccagagcggcggcctggatgtcgtcgatctccagggcgttgcccttctcgatgctcatgatgccttccagaactgtcttgcgtggacggagtcgtcacgcgggtcgtggagggggcgtgggtggcgccccttcccggaggggtgggtgtggtgccctccgggggtgggggtgggtcagctggcggcctgggcgagcagcggcttgagggccgggtgctggagggcctcctcggcggcggggtcgtccaggacctcctggaaggcggcgttgatccgctcggccttggtgatctccgacatcgtcagggagctgaccgggttccagtaggcggtggccttctgctgcccgtcctgcaggatccacctcatgccggccatgttcgcgatgatgtgctcgtcgaagccctcgcgcgttttgtcgcccgtgagcgactcgaggccgccggacttctcgatccacggggcgatcttggtgtcccactcggtggtgtgctgcatccagtccacgaagtgctcgaagccgacggtcaggaacgcgtcgtcgatgtagggctcccactccgtctcgaaggtggtggcccacagcagctccgtgccgttgttgaagatcacgtggcgggtgtcacgcagaccggtcttgatggtggcggccatgggggcctgcttcagggcctcgaccatccgctggcaggccgccgcgcactcctgctcgtgccccggcttgatgtggaagtacgtggccatctcggaaacgacaccgtcggtggcgcccttgcccgccttcttcgtgaccgtagcgttcatggattcctccattagagaccttgtgcgcgaatgccatggcattgacgacatctatggacagttgcgggatccgccttttcgcgaaccccctgtgagacaggttgactcacagagagtctatgagtcaacttgtctcaaagagacctgcgtcacaccgactcagtccacaggcgcgcagtgatcgaatcggtggcacccgcgccggaccgcgagccgatcggctcgcgccgacaggttctgccgactgccactgaagcagtcggggaacccagagatgacaggacctcgcagcccttcatcggcgcgaaggaatgccgccttggtcagccccggccgaacggcggacatccagccacgccggggactcaacgacgctaggaccagccccgcatagcggcatccacgacggcctccacggtgtcccgccccagacggttcccagcgagaaagcgctcgaagaacaaggggcccgcggtagccatggcaaaggtctcgggggtgacgtcggaccggagccggccgcgctccacggccacggcaacagcgggacgcagggcatcggcgatctggttcagcagcgactcccggaggcggcgcatgccttcgtcatgccgtgagccgccgaggatcgcagcaagcacggcaccggactgctcgtcgtcccatcgctcggcaagcacgccgagacggtgaacgagctccgctcgcggatcgttgcccgaagcggcccgaagctcctcaggcatcggaggcagagggggcatgccggcttccagcgcggccaggcgtaggtcgagaaggccgggccagtgccgatagacggtggctctgccaacgccggcgcgggtggcgaccgtttgatgcgtcacggcctccagccccccttccgtgagcaacgcggtggccgccgagaccatggcgtcacggctgcgcaacaaacgcggatcggttctgtcttccacccctctgttcccttctatgagacaacgcagcttacagcctactatgagacattccgtctcagagatgggaactgggtagccgcagagaacctgcgggactatcccggggctgccccgtcaaaggtaaccgtgcccttccccccttcgttcctcccgcacggcccgcgcccctctcggacagacccgttcgttgatcacatgtgaacgacaggcgcggcgttctcgtcctgctgcggcacgccgcggcggtagagcagggcggtcacgcccaggccgatgacgaagacggccgccgaccaccagtaggcagtggagtagccctcgaggccggcctgggccaggacgtcggggtccttggggttgcggccggagaggtagtcggtgacggcgtcggaggccatcgtgctgagcagggcgacgccgatggacccgccgacctgctggacggtgttgacggcggcggacgccgccccggcgtcggccgccgccacgccggaggtggccaggctcatcgcgggcgcgatgaccgcgcccaacccgatgccgacgagcaccagttgtggcagtacctgcgtcacgtatccgctgttcaggtccaacgcggtcatccagaccaggccgacggccgcaatggccatgcccagcggtaccaccggcttggggcctatgcgcggcaccaggacgttggcggccacggcggaggcggacgacgaggccacgatcatgggcaggaaggcgaagccggtcttcagggcgctgtaaccgaggctctgctgcaggtagtaggtcaggaacaggaacacgccgaacatgcccgccccgctgacgaagagggcagcgaaggaggcgccgcggttacggtccagcaggacccgcaggggcagcagtggatatgccgccttgctctgccaccagccgaagaggcccaccaggacggtaccggccgcgagcatgccccacgtcgccaccgaaccccagccgtgcgtctcggcgttcgagaaaccgtagaccaggcagaacaggccggcggagaccagcaaggtgccggggatgtcgagcttcgaggacgtgtcccgcgaggtgcggcgcagcagggctgcgccaccggcgaacgccaccaccgcgaagaccacgttgacgtacatggtccagcgccagtccaggtactcggtcagcaccccgccgaggatcaggccgatggcgccacccgcaccggcgaccgagcctgcgacggtgaaggccttcgcacgctcgcgcggatcggtgaaggtggtcatcagaagcgacagcgcggacggggccagcagggcggcgaacccgccctggaccgcgcgcgcggcgacgagcatgccgaatccgttcgccgcgcctcccaccatggaagcggccgcgaaaccggccagacccaccaggaaggtcaccttccgcccgacaaggtctgcgacccggccgccgagcagtagcaggctgccgaaggccagcgcataggcggtgaccacccactgccggtcggcgtccgagaagcccagctcgcgctgggcggacggcagagcgatgttcacgatggtgccgtcgaggactcccatcagttgggcgagggaaatgaccaccagaatccaccagcggcgctggtgtgacgggtcgacagccccattcttcggtgcggtctcaacgccgcgagcggcggcgacggtgttctgcgacatggggacagccctccaggcaacggacgagggtatggcggaatgagacagggacaaaggcaggcggagagatcgattacggctgtgggacgacgtgaccgcctcggtgaagaggatcgcgacgcccccgtggaggcctaaggccggccaccgcgcccaggttcttgtgccggtactccttcggcggacggtcgcgcggagccgcgatcgcgttgggcgaacaccgggttcgcgtacggcgtgctgcacgtcgggagggcatcacgcgccctcttcggcggccaggtcgggaacctgggcgttgtcgcccgcgacccgcacgtggtcgaggcccctgacctggagggtgcagggtgtcgacgtggccacgcgggccgagcggcaggccgaagtgggccaaggcggggttggagccgacgccggctgtccagccgaccccgacgagcagacccgagcccccgcccaggggagcctgccggccgaacgaagtcggcgcggtcgtttcatacgccgtacggtatctcacttgttccgtacgtcgtatgaaataggtgtgggcaggagggtgccgtggagagcccctcccgcctgccgcccgggtgcggtcaggagtcgccgatccccagatcagcggccgcccgcctaccgccagcgagtatcacggcgacgtgcacggtctgagcccacccgtgccgacggcccatgtctcaccggttgtcgcggcctcggtcgtcgttgaaccggttggagtcgcggtcatccgcttcgagtcgtggtcataccgaggtcgtggagggggcgtgggtggcgccccttcccggagggggtgggcgtggtgccccctccgggggtgggggtgggtcagctggcggcctgggcgagcagcggcttgagggccgggtgctggagggcctcctcggcggcggggtcgtccaggacctcctggaaggcggcgttgatccgctcggccttggtgatctccgacatcgtcagggagctgaccgggttccagtaggcggtggccttctgctgcccgtcctgcaggatccacctcatgccggccatgttcgcgatgatgtgctcgtcgaagccctcgcgcgttttgtcgcccgtgagcgactcgaggccgccggacttctcgatccacggggcgatcttggtgtcccactcggtggtgtgctgcatccagtccacgaagtgctcgaagccgacggtcaggaacgcgtcgtcgatgtagggctcccactccgtctcgaaggtggtggcccacagcagctccgtgccgttgttgaagatcacgtggcgggtgtcacgcagaccggtcttgatggtggcggccatgggggcctgcttcagggcctcgaccatccgctggcaggccgccgcgcactcctgctcgtgccccggcttgatgtggaagtacgtggccatctcggaaacgacaccgtcggtggcgcccttgcccgccttcttcgtgaccgtagcgttcatggattcctccattagagaccttgtgcgcgaatgccatggcattgacgacatctatggacagttgcgggatccgccttttcgcgaaccccctgtgagacaggttgactcacagagagtctatgagtcaacttgtctcaaagagtcctacgtcacaccactggccttcagttcacatacggccgcgactctggcgtacgcgagtcaccctcggcacaccgaccgggggcgacattgacaaagtcacgacggccgcacagccgcatggccgtcggtcggactctgcacaggtgcgcgcgtggtgaaggcgccgaatcccacttcggtgtatacattcgaccactccgctgacctggggaaatgaggtacccgcagcaaatgtggctggacaggcggcacatgacgtggatccccgctcgtggcatggccagtcagctttccggcgccaggcccttcagccgtgcggccacactgctggagaagctgggtgctcggttccctcgggccgtaagatcggtgatctcgtgggggaggtggtcatgggcaggcgacgccctggcgcgccgacgctggaggaggtggccgcccacgccggagtggggcggggcacggtctcccgcgtcatcaacaacgcggccggcgtgaaggagtcgacgcgccgggctgtgcagcaagccatccaggaactgggctacgtgcccaatctcgccgcccgctcactggccgggcaacgggccgacgccgtcgccctcgtcttgacggagccggactggaggcagttcgcggagccgttcttctccgagatcgtccgctcactcggggacgcgctggcagacaccgggatgcaactgctgctgaccttggtccgctcggacgccgagcggcagcgcttcctcgagttcgcgcgtggcggtcgggtcgacggagccctgcttgtgtccgtacacgacggcgatctactgccggacatgctcgtcgaggccgggttgccgaccgtactgctgggccgccgctcgggcgacgagtacgtcagctacgtcgacgcggacaacgtcggcggtgcccgcagcgccgtctctcacctgctgaaacggggccgcagagcgatcgccaccgtcaccgggccactcgatatgcacgtcgcccagtgccgactgcgcgggtaccaggaggccctggcgatggcgggtctcaggggcgagccgtcctgggtcgccgagagtgacttcacggaagagagcgggcgccgcgccatggccgagctcatcgaacggcatccggagatcgacggcgtcatcgccgcgtcggacaccacggcggcgggggctcttcaggcgctgcacgcggcgggacggcgggtgcccgaggacgtcgccgtgatcggtttcgacgactttccgctggctcagcagaccaagccgcgactgacgacggttcgtcagccgctggaggagatcgggcgggccatggtccggctgctcctcgaggaggtggaggagcctgccgtggcctggcaccacgtcatcctccgtacggagctggtggtgcgcgagtcggcctgaccgccctcggcaagcacagcacttttgggagcgctcccaagaaggatctggtgctggcgcacacacttctcctctgacctgcggcttcgaaaaatgcttccacaggttcacgccgacagtcttgtcaggaacatgaacccctcctagtgtccctgccgaaaccgagggaatgggagcgctcccacctcgcgtgatgggagcgctcccgaacctactcccccaccccttcggagaggatccgcatgcgaccgtcaccgccccatgcccgcagcgcgcgtggcctgttcggtgccctgctcactgcgctcgtctcgctggccgcgttgctgaccaccgcctcggtggcgcaggccgacaccagcatctgcgaaccgttcgggtcaacgacgatccagggccgctacgtcgtccagaacaaccgctggggcaccagcgaggcccagtgcatcaccgccaccgactcgggattcaggatcacccaggccgacggctcggtacccacgaacggcgccccgaagtcctacccgtccgtctacaacggctgccactacaccaattgctcgcccggcacgagccttccggcccagctcagtaccgtctccagcgcgccgaccagcatctcctacagctatgtcagcaacgcgatgtacgacgccgcgtacgacatctggctcgaccccacgccccgcaccgacggcgtcaaccggaccgagatcatggtctggttcaacaaggtcggatccgttcagcccgtgggctcgcaggtcggcacggccaccgtggccgggcgccagtggcaggtgtggtccggcaacaacggctcgaacgacgtgctgtccttcgtggcgccgtcggcgatcaccagctggagcttcgacgtcatggacttcgtccggcaggccgtttcccgcgggctggcgcagaacagctggtacctgaccagcgttcaggcgggcttcgagccctggcagaacggcgccggcctcgccgtgacctcgttctcctccacggtcaacaccggcggcggcaaccccggtgaccccggcagccccacagcctgcaaggtggcctacgcgacgaacgtctggcagggcggcttcaccgccgacgtcaccgtcaccaacaccggttcctcccccgtcaacggctggaagctggcgttcaccctgcccgccggacagcagatcaccagcagctggagcgccggcgtctccccgtcatcgggagcggtcacggcaagcagcctcgcgtacaacgcgcagatcgcgaccggcggccgggtgtccttcggcttccagggcagctactccggcaccttcgccgcgcccgccggcttcagcctgaacggcgccgcctgcaccaccgcctgacacatccgcccgcaccggggcccgcccgccttccccgccgtcgagcgggcgggcccccggccccgctcggcgccgcccgctcccggcccctcccggaatggcccacccgcatgcgcgtcctgaccacccgccgcggaccggcggcggccgccctggccctgtgcgccaccgccctgcccctcctcgggccgaccgccgccgtcccggagcccgccgccacctcgcccaccgccggcctcctggctgcccgcaccgggcgccggcgtctccgacgtactgttcggcgactactcccccaccggcaagctgccggtgacctggatgaagagcgcctcgcaggagccgatcaacgacggcgacggcaaggctgcgctcttcccgtacgggtacgggctgacgtacgacgccacggacccgaccccgacgcagggcgcgtgcaccgcgcagttccgcaccgtttcctcctggcagggcggctaccaggcggaggccaccgtcaagaacaccggctccgccgcgctgacgggctggactgtcgactgggatccggccggctccaccatcaccagcctctggaacggctcactgaccaccgcccaggaccgagccaccgtccgcaacgccgccttcaacggctccctgcgccccggcgccaccaccccgttcggcttcaccgcgaacggccccacggacacaccggccccgcactgcacgagcagctgaccgcacgtcggccccgtgcccacggaccacacctcgcagctccacccccacaccacctcgtaccacccacagatcactcacgaggagggcacatgacacaccgaaccggccgagcaccggaacacgggccgagaccgggccgtcgacggcgccggacgacctcggtcgccgcggcgctcgtcaccctggcgctgggcctggcagggcagctggccgggcatccggcggccgccgccgaagcccacgccgacaacccgttcgccggagcgagcttctacgtcaaccccgactacaccgacctcgtcggcacctcggcggcgcagacctcggacgccacgctcaaggccaggatgcagaaggtggggacctatcccaccgcggtgtggctcgaccgcatcgccgccatcacgggcggtgccgccaacgccggacgcaagagcctcgccgaccacctcgacctggccctggcccagaagaagcccggtcagccgatcaccgccacgttcgtggtctacgacctgcccggccgggactgctcggcgctcgcctccaacggcgaactcccgctgacccaagcggggttggaccgctacaagagcgagtacgtcgacgccatcgcgaacgtcttcaagaacccgaagtaccgtgacatccgcatcacgacggtcatcgagccggacggcctgcccaacctcgtgaccaacaccgccgacccggagtgcgcccaggccaagagcagcggcatctacgtcaagggcatccagtacgccctcgacagactgcacgccatccccaacgtctacacgtacctggacttcgcgcactccggctggctcggctgggacaacaacctttcccagaccgtgcagctctacaccgatgtcgccaagggcaccgcggccggattctccagtgccgacgggctgatcacccacgtctccaactacacgccgctcgaagagccgttcctgaccgatcccgacaagaccgtcggcgggaacatggtcaagtccagcaagttctacgagtggaaccccaacttcgacgagtcggacttcaccgggaacgtccaccgggcgctcgtcgcggccggctggcccgcttcgacgggcatggtgatcgacacctcccgcaacgggtggggcggcaccggacgccccaccacggagagcagcagcaccaccctcgacacctacgtcaatgagtcccgcgtcgaccgacgggcacaccgaggcctgtggtgcaacgtcagcggcgccggactcgggcagcccccgcaggctgcgccctccggctcccctgactcccacctcgacgcattcctgtggatcaagccgccgggtgagtcggacggcgccagctccgacattcccaacgacgagggcaagcgcatggaccccatgtgcgacccgacatacacggcgcccaacgcgggcggcaacaagaccggcgcgctgccgaacgcgcccctggcgggccactggttcgccgagcagttcgcgatgctggtgaggaacgcctacccggccgtgctcacggacggtggcggcaccccgggcggtgacaccaccgcgccgaccgcaccgaccggcctgaaggccaccgcgaagacgccgtccagcgtctccctgtcctggacggcgtccaccgacgacacgggcgtgagcgggtacgacctctaccgcggcggcacgaaggtcacggcctcgccggtggccggcacagcgttcacggacacggggctcagcgcgggcaccgcgtacagctacaccgtccgcgcccgtgacgccgccgggaacgtctcggcgccttccgcctcgctgagcgtcaccaccgacacgtccggcggcacaccggacccctcgggcggcctcaaggtcctctacaagaacaacgactcctcggccaccgacaacgccatccggccaggccttcggatcgtcaacaccggcagcggctccctcgacctgtccaaggtcacggcccgctactacttcacccgggacagcggctcgcccaccgtgaacgcctggtgcgactacgcggccgtcggctgttccaacgtcagcctgaaggtcgtacccctgaccacgcccgtgccgggagccgacgcctacctcgaagtcggcttcaccggcggcaccctggccgtcggccagaacaccggcgacctgcaactgcggatgagcaagtccgactggtcgaacttcgacgaggtcggcgactacagccgcggcacctccactacgtacaccgaagccgcagcgatccccgcgtatctcagtgccacgcccgcctggggagccccgcccgcctgacccacccgcgccgggcacctgccggcgcagcccgaacgtcctcgcccgcccggtcggcgcacgccccgggcgggcgaggaccccacttcttcgtccacaacgccgtccccgccgacagccgccccggctcccgagctccctcagggaattcggggccttcgtctgcttgagcgccttcccgcgggcctcgatcgaggcttcgagctcggccttcttctgctcccggcgcgccttggcggcctcgcgttccgccgcctcgtccgcctcgcggaccgccttgacctcggctcgcacccgctcggccggcctgcgctcaagcaccgcaccgaactgcgtggcgaacaggtcgatcgctgccgtgtcgcgctcggcgacctctgcaaccagcaccgtgctgcccgcgctgacctcgtcggccaccagggccaccaggccggagctctccgtcgcccgccgccagtcggcgccgccgcccaccagggcgccggcgccccagcccagcaccacaccaagcggtccacccagcagacccgccaccgaaccgaccagccctccgaccagcgtgccccctcccgccctggcgtcgacaccctcgggaatgcgcaccgtcccgtccggtcggcgctcgacgagcatcgcgcccgtgacctccacggtcggggcgccgagctgcttcagctcactgagcgcctggtaggcggaggcctgttcggtaaagcggaagacgacgacgttctcggtcctggccatggccactcctcaaccactcataggtcctgtactcggcgggagagccccccacctgtgagacatcacgtatcgcagatgttctgtgagtcaagccgtctcatagacgtcgagtgatatcggcggcgacccccgcagaggcaaggaagctgttcggcgactccctcgacaagcccggtcaccgccccgcgtacaacagcctcaagatcctcaaccgactccgggagcgtggatacaaacccggccaccttgcgggcgaccggccctgccggtcggtcagatcctcggcgaactacaagcccatgaccaacggggcgacatgcccggaaccccgcgcacgccgaacgacgcggcaaacggtgcgccagcgaagacttccgcgagacggtcccgcacccgtatcggcagactgccgtgcgggaacgcggcccgggccaccagctcggtccgctccgggatcttcggcaacccctccggctgccgcgacatccacaccacccacacgaccgcacgacaggtcaacggccgcgcagacgatcaccccgcacccacggcctgcccaccccagccccgcggaattgcgcagcagagtcccggtccgccgcaagccacgtcttggccgctcagcaggccggcacacccaggccgcgaccagatccggtgagccgcacctcagcgccgcgaacccccgcgttcgacattttcggacattctctgatatcactgtacttccatacagcgtatggaacggagcggagtgccgccgaaacggcgtcctttcgctgcgactgatggccgtcggcagtgccctcacgaggggctcgccgatgcggcttcgacatagatggggcgcaccgcatcacctgcgtaagcaatcgccgggatcgcggtcgacgccaatacgaaggagatatccatgaagctcacgaagcgcatttctctcgctgccgcctccgctgcggtcgcgggtggcgcccttctcggcgccgggggcaccgcctcggcggcggttcccgagtctgcgcacattgagcgcccggccgtaagcatcaaggccgacgactaccgcgaggaccgcggtgtcaactaccgacacaactccgaggaggactaccgccgggacgggtaccgcgcccgacagcacagcgaccacttcagcgactcggaccgctacgaccgccgcggtcactcctattactgggacgacgaggaccgttgctggaagcacgacagcaactaccgctacgactgggaccggtccgaccgccgcgactccaaccgggatgaccgcgactggaaccggtatgaccacgactggaaccggtatgaccacgactccaaccgatccaaccacgaccgagtcctcgacaaccggtgagacaggcgccgttggcacgggtgggctcagaccgtgcacgtcgctgtgacaaccactggcgatagggaggcgaccgctgaccttgggatcagcgactcctgaccgcgtacgggcgggaggcaggagggggctcaacggcaccctcccgcctcccgcctgtcgacattccatacagcgtgcggaatagctgatgccgtacagcgcatgaaacatccgcaccgacttcgtccggccggaagacccctttgggcgaatgctcacgggcctgctcgtcggaatcggcagccaccgacgagagccgcggccggcgacgaggtgagaacggctgctgcgcggcgagaaccgcccaccttgatcacgttcgatcagaagtgagggaagaccgcacatgacagccgcgcccacggccaccggcggcctccgctcccgatggcgacgcacatccggctcgatgggccgcgccgagtggggccgcgcagccgggatggccgccttcatcatcgcgctccatgtcatcgggtggttcacgctggtggcgatcgtggccccggagcactacagcgtgggcaccaagggcttcgggatcggtatcggggtgagcgcttacaccctgggcatgcggcatgcgttcgacgctgaccacatcgccgcgatcgacaacaccacccgcaagctcatggacgaagggcaacgccccgtgtcggtcggcttctggttctccctggggcactccagcatcgtgttcgtgctggccctcctgctctccctgggcgtcaaatcccttgccgcaccggtccgcgaggacaactccgagctgcaccacgtcaccgagctgatcggcacgaccgtctccgggacgttcctctacctcatcgccatcatcaacatcgtcatccttgccggcatctggaaggtgttccggcagatgcggtccggccacttcgacgaggccgcgctggagcagcagctcaacaaccgcggcctcatcaaccgcctgctgggacgcgtgatgaagtcgatcaccaagccgtggcagatgtatccgctcggtctgctgttcggtctcggcttcgacaccgccaccgaggtcgctctgctggtgctggccggctccggagccgcctccggcctgccctggtacaccatcctctgcctgccggtccttttcgcggccggcatgagcctgctggacaccatcgacggttctttcatgaacttcgcctacggctgggccttttccaagccggtacggaaggtctactacaacctcaccatcaccggcctgtccgtcgccgtcgcgctgatcatcggcaccgccgagctcctgggcctgctcgccgacaaggccggcctgcacggcgtgttctgggactggatcagcggcctggacctgaacaccatcggcttcgtcatcgtcggcctgttcttcgccacgtgggctgccgccctggccgtgtggaagctcggccgtatagaggagaagtggacggctggactgcggccccccgagcaacaggccgaccgacagcggtgatgcgtaagctcggcaggacggcgtacttattgtcacggtgccgatcggcgccctggtctcgttctcgtgccctgacaccgctgcagaaactccttcacagccaccgctaaaaaatgggcgcaggtactcagaagagcacccgcgcccacggcatggcgcctctcacccaccagacggcggcagtgcctcaggcataggcgacggcgtcctcgacgggcacgcggggcagccgcgggaaccacgggtcggcgccggggtgaccgatgttgaccaccagatgcgaacgccagctggtaccggcgaagaactcctcgtccacgccggccctgtcgaagcccgccatgggaccggccgccagccccgccgcacgcaccgcgagcaggaagaccccggtctgcagtgccgagttgtaggccgcgaggctctcgcgcttctccgtctggtcggcgaacgccgctcgcagcatctcgccgcgagccgggaagacggtcggcatctgctcgtggaagtcgacgtcgtacgccaggatcgccacggccggcgcactgagcgtcttggccctgttgccctcgtcgagatgccggcccagtcgctccttgccctcgggggtgcgcacaaagagcacacgcagaggctgaccgttggcggcgctcggcgaccagcgggcgagttcccagatcatggcgagctcgtcgtcggcaacggccacctcggcaaaggtgttcgcggtgcgggcctcggtgaacagcacctttcgtccggcgtcgtcgaggacatcgagggcctgcggttcgcggtcggtcatgctcatcatttctctcttacttcggttgtgtgtggtgccggggcgggttgaccgccccggcaccaccccgtggggacggggtttgcggagccgggcggggcacaaggacccggtgctgtcacgtgggcctgtggtcccctggccgactcatgtgtggtgtgctgaccgcttgttccgctccgcgcccaggcgggcgaagtaggcgatcaggtcggggttgtcgaccgccgaggggttcaggacctgctcggcgggagcgccctggagcaggcgcttgacgggaacctcgagtttcttgccggtcttcgtgtgcgggagggccggtacggcgaggatctcgtcggggacgtggcggggtgaggcgccggcgcggatcgcgtcgcggatcttcgcgcgcagggagtcgtccaggccgaccccgtcggcgaggaccacgaagagcggcatccagtagccgccgtcgggttcctccgcgccgatgacgagggcctcggtgatctcggggaggcgttcgacgacgtcgtggatgtcggcgctgcccaggcgcacgccgttgcggttgagggtggcgtcggagcggccgtggacgatcaccgagccgtgcgaggtgagcgtgatccagtcaccgtgccgccacacaccggggtaggcgccgaagtaggcgtcgcggtagcggctgccgtcggggtcgttccagaagtacagcggcatggacggcatggggcgggtgacgaccagttcaccgacccggtccgtgacggggaggccttcctcgtcgtaggcggccagcgccacgcccaggccgggggcggacagctcccccgcccagacgggggtcgtggcggcactgccggcgaagccggagacgatgtccgtgccgccgctggtggaggccagctggacgcctgcgcccacgtggtcgcggacccaggggtaggcggaggcgggcagagcggagccggtgcagccgacgacgcggatggccgacaggtcgtacacggagggtgcgatgcccagcttggacatggccagcaggtactgaggactggtgccgaagacggtgaccttgtgacgggccgccagctcccacaggacgtccggacgcgcctgcggtgccgggctgccgtcgtaggtgcaggtggtggcaccggtcagcagggtggagacgaccaggttccacatcatccagtgggtggtggtgtaccacagcaggcggtccccgatgcccagatcggtgtgcaggccgagcatcttgaggtgttcgagcaggaccccgccgtggccgtggacgatgcccttgggcagtccggtggtgccggaggagaagacgacccagagagggtggtcgaacggcaccggggcgatggtgaggtactcggcgcgggtggccgcgtcctcccagggaactgtcagccccaagtccccgccctcgggccaggcaaggcccacgtgatccacgagcaccgtggccttcagcgtcggcagggcgacggcgagttcgagcgaggcggcgcggcggtcgtgtgtggtgccgttgaagaggtagccgtcagcggtgatgagcaccgtgggttcgagctgggcgaagcggtcggcggcggccttgggtacgtagtcctggccgcacaccgaccacaccgcgcccaggcttgcggtggcgaggaaggcgatgacggcgtggggggtgttgggcagatagcccaccacccggtcgccctgtgcgacgcccaggtcgcgcaggctggcagcgacggaggcgacccgggcgcgcagctcccggcccgtgatctcatagccggctccggtctcgtccagggcggtgatcgcgggagcgtccggctgcaggttgcgtagcgcgtgatggacgtagttgagggtggcgccggggaaccagcgggcgccgggcatggtctcctcggccagcaccccctcgtactcagtcgtcgcgtcgatgtcgaagtactcccacaccgcggcccagaacccttcgaggtcggtgacggaccactggtacagggctcggtagtccgtggggtcctggatcccttcggcgccctggtgccgggccgcccatcgggcgaagtccgcgatacggctgtgggcggccgacttcgggtcgggagtgaagaagggttccggatacggcgcggggtgcggggtggtcatgtggtgctcctcgtcaggcgggccgggcgtcggcggtatggcgggccgtgtgcagcaggggggcccaggcgacggtgtccgtgaagtcgccggtgccggcctggacggtgtccatcacgacgcggtcggggcgcagcaggacggcgtcggcacggccgcgtgccagccagccggccagggtgccgtcgtcgcgcaggtcctcgacgtggaccgtcggagcgcccagtgccgtagccacggccgtcatctgcgccgtgggcggcacagcggtcacgacggcgaaggagtccccgaggacgtcatcgaggcgcactcgcctgccgtcatgccgtacccagggctgcgggcagatcgtgccggccagcacgcggccggtcagcctggggcggcgccgtacgagtggaccggcggtcagggcggggctgaggtcacggctcaccgccgcggtcacgccggggatgcgagaggccgtgcccacgacggcccggcggaacgccgcaccgcggtcctgtccgccggtcatggcccagccgacggcgaccgcgacgcggatcacatggcgggcgtgcggcttgcgctcgcgttcgtaggtgtccagcagcccgtcgtgtgcgccctgttggagcacgcgggcgagcttccaggtgaggttgtaggcgtcgcgcaggcccgcgcacagaccctgcccgacgaagggcggggtgaggtgggcggcgtcgcccagcaggaagacacgccccctgcgccatcggtcggcgaggcgggcccggaaggtgtactgcgcctgccgcaccacctcgaagtcgtcgcccgccgaggcgtcgggcggcaggtccacccagggggcgaccagctcgcgcaggcgctcccatccgtccgggccgtccaggttttcgtcctcgggcagccggaactcccagcggtagcggtcctcgccgacgcgcatgaaggtggccggtcggttggggcagcagatctgctcggcgccttcccaggtgcgcacctggcgggtggtgcgcacgtcgatgactctccagctctcctggaagtgcaggtcctcccacacggcgccgatggagtcacgggtgaggctgcccgcgccgtcgcagccgaggacggcatcggcccacacgtgctcctcctcgtcgctgccgtcgcggcggaaggtgacccgggccggacccgtcggatcgttcggtccgtcggtgtcctgggtgacggacacgacctccaccccgccctgcagctcgcactccgggcggcgcgccagggcgctgcgcagcacgcgttccagctcgggctggtcgaacatgctggtctccgggaagccgtggtgtccgtgcatggaccgcgggaactcggtgatcacgcggcgccgggcgtccagcagccgcagcccgagcgccgggcgggcgagagcagcgaaatcctcgtggacaccgacgctttgcaggatccgacggatctcgtcgtccacgacgacggcgcgcggcagagggtagatgtcccgatggcgttcgaggagcaagctgcgcactccgtaccgggcgagcagcaggccggccatgaccccgacgggtcccccaccgatgatcaccaccggcctctgggatgcggccttcacgctgcgtccgtaacgggggttcgctgctcaccgaggtcgatccgcccgtccggggtggcgatcgtggcggtgatgaggtctccgttgcgcaggtacttggggttcttggcctggcccttgaagaacgccttccacttcagtgcgggcgggagcagcgcagcgatcttctcggccgccttgggcggagccttcagggccgtgccgccgggagtgccggtcagcagcaggtcacccgggtcgagggtctggaagcgggcgagcagcgtgagcgcctgtgcgggccgtacgatcatgtcggccagcgtgcggtcctggcgggacacgccgttgaccgacagctgcaaccgcaggttcagcagatgggcgaagtcttcgggctccagcagggccaggtacggacccgtcggcgtgaaggtcggataggacttgctctcgtagaactgggtcttggtcagctggacgtcgcgggcgctgacgtcgttggtcaggacaaggccggcgacatagcgcggcaggtcctgctcctcgacgacggtgcccacgggaagggtcgcgcccatgacgaggccgagttccacctcgtagtcgaggaacttcacgtgcgcggggcggatgatcgtgtcatgggggccgctgaccgagccggacgccttacggaagaaggtggccgggatgtcgccggtgaagcccgaatccttggcgtggctgcggtagttgaccatctgggcgaccacccggcacggggtggtgaccggaggcagcgccaccaggtcggcgacgggagtgccgctctcggcagaggcggcggcctcgcggaccgcgtcccggtcggcgagcagctcgccggtggtgaccgccttggtctggacgcggacggcgcgctcgtcccggacgacccaccagccgtcgttggtgcgcagaacgttggtgctcatgagctcatcgctttcatcaggcccagcaggcgtgcggggtcgagttcgttgtcgccacgcagggccgtcatgacctcgcgcagcttggcgggggacgggctggcgcccaggaagtcgcgggtgacgggcgggccccactgggccaggccgctcgccgacatcggcgcccagccgggctccaggtcgcaggagaacaggtcgccgtcggcgaagtgctccagcatgaagtgatcggggtcgcgccagtagtcgaacagctggctgccctggatgtgccgcccgatgccccagctgcgctggtaaccacgctcggccaggtactccccgccggcgccgatcgcgtcgaggtcggtgacctggtaggcggagtggacgtagccggtaccgggccccaggtgcagggccagcgtgtggtgatcgacggccacgctcccctggtcgcaccggacgaacgccatcgtcggcccgcgcccgcgctgcccgtccaggaacaggaagtcggacacgatcatcccgagggtgtccaggtaccagtccagagtgcgggcgaacacccgggtctccagcaccacatggcccagccgctggatacgggacggctcacggggcggacgctgggtggcgttcgtacgacggtgatcggtaccgaagttgaggatcagcggctcctgctcgggcagcgcgggcagctgctcggcgcagtgcacgacccggaccggcaggcccgagggatcgagcagggcgaccgactgcccaccgcccggtacgccgatgtcccggacggtactgccggtggtgccggccagccggtccaggtcggcccgctcggccgcgcggaacgccggcccgatgaaccgggacgcacgcccccgccggatcaccatgcagggcgagccggcgaaggtaccgcgcagccacagctccccctcggtgcgggcggcgatcgcgaacccgaagtcacgggcgaagacctcggcctggtccaggtcgggcttctcgaactcgagccaggccaggtcggccaccttgatcacgggattccgggaacgtccgggatgctctccgcgcagggcgccctgctcactgtggaggtcttggtggggcgtctggggagcggccctgttaacgggggtgtgggacatggtgtcctccaagcaacactgctgtaatgaggaaatcatcaactttgccgttacccatcgtcaatagggtggacccaaataattgatgatctcatcactaatggcagactgatcgctacggttgttacacttgccgtatgccgacgtcagccccgcccaagaaccgcttcgagcggcgccgcgccgagacgcgtcaggcgctcgtccgtgcggcccggcagatcctcgcggagaccggggacaccagcgccagcatccaggccatcgccgagcgcgcggacgtcggtttcggctccttctacaaccacttcgagtccaagacggagctgttcgacgccgcggtgacagacgccctggacgagttcgggcaggtcatcgacgagcgcgtagaaggaatcgacgacccggccgagctcgtcgccgcgggcttccggctcaccgcccgcatggccgactcccaccccgaactcatgcggatcctgcgtgaccgcggtctggcctacatccactccgcccgcggactcgccccgcgagccctgcgcgacctggagaacggcatcgcctcgggccgcttcacctgccgcaacgcgaccaccgccctgtccgccttgggcggcaccctgatgtccctcgtggcgctgcggctggcccgccccgacctcgacggggacgaggccgcctcggacctggccgagatggtcctgcgcatgctgggcgtcccgccggacgacgcccaccaggtgacccggcgcccgctgcccgacctggattaacccgggcaccgggcgcgccaggccccgtggagaccggaaagccgtgggtgtcactccgtccgccggtggccgcgcggacccctgccctcgaccacgaccagcccgtgagaccgggctcctcccggacaccgcgcagccagctgcggccggccgaggcttcgtggtccaccctgacggcgtaacgtcgtcagggtggacctcaccgcggacagtcttctgtcccgtgccgcgcatgaactcagcccgcgagcggacgaggtgatccacgacgtagagcaatgcctgcggcgcgagatccccgagctgtgggacgaacccgacatcgcacagatgacgagggagaacgtcgccgagcacgtcgtcgccctgcttttcggcatcgagcacagcatcgagccaaggcggatcgatcagccggccgccgacgcagagcgcgcgcgtcggctggctcagcgcggaaagccggtcacggcaatgctgcgcgccttccccctcgcgcacgcccgtgtcctcgaccggctgctcgaagagctgccccggctcaccagcgatgccgagtcgatcaacgcggcggcacgcaagctgatcgcactgtcgatcgcgtacatggcccgcacatcggagacgggcgttctggccttccaggaggagcgggatcgccagctgcagtggcggctgtcggtggtgaacgaggcgagcgtacgcgtcggaacgaccctggacatcgcccgcaccgcccaggagctggtggacctggccaccgagcacttcgccgacgccgtcaccgtcgacctcctcgacatgccttccggagacgagcctcctgcgaagggcacactcgtggtccgccgaatcgcccagcagtcggtgatggacggttaccccgagacgacctccctagaagcgatctacggggaattgccggtttcgccgcagcaggtccacaggtatccggacggatcaccaccggctcgcgccctggccaccggccggccctcacggcaccacctcggcccgtccgcatcaatgctgctggtaccgctgtgcgcccgtggcaccacgctgggtgtcgttcagttcttccgtcaccacaggcccgacgcgtacggggacgaggacctgctcctcgcccaggaggtcgcggccagggcggcggtcgccatcgacaacgcccgccgatacacgcacgcccgtgccaccgccctcaccctccagcgcagtctgctcccgcgcagacacccgcgcagtccgccgtggaggtcgcctgccgctacctgcctgctgccgcccagctcggcgtgggcggcgactggtacgacgtcatcccgctgtccggtgcccgggtcgcactcgtggtgggcgacgtggtcggccacggcatccacgccgccgccaccatgggccggctgcggaccgccgtgcgcaccctcgccgacatcgacctgccgcccgacgaactcctcacccacctggacgacgtcgtcatccgcctgtccgccgaagtctcttccgaagcctctgcccaaacggacaccgaatccgcaggggacatcggggccacctgcctgtacgccgtatacgatcccgtcgccggccgctgcaccctcgcccgcgcgggccacgtgctgcccgtcgtgatggcccgggacggaatcgccgacatcctcgagctgcccgccggcccgccactcggcctgggcggcctgccgttcgaggcggcggagatcgacctgcccgagggcagcctcatcgccctctacaccgacggcctggtcgaggccctcgaccacgacatcgaggcgggcctcacccgactgtgccacgccctcgcgcagccctccgcctccctggaggcgacctgcgacaccgccctcgatgcgctgctgcccgcaggccgaccgcacgacgacgtggcactcctcctggcccgcacccacaccctcggggaacgtcaggtcgtcacttgggacgtggatgccgacccggccgaggtcgcccgggccagagcgcatgtctccgagcagctgaccacctggggactggaggaactcgacttcaccaccgaactggtcgtcagcgaactggtcaccaacgccatccgctacggccggcctcccatccagctgcgtctcatccacgatcgcaccctcatgtgcgaggtagcggatgccggcagcacgactccgcacctgcgccgggcccgtgtcttcgacgagggcgggcgaggtctgttccttgtcgcccaactcgccgagcactggggaacgcgccatgcccgacgtggcaagacggtctgggcggagtgcgccctgggcgcgccggagctcttctcgacagggctggacctggaaggtattcccggggtcgtatgaacaccatctcgcccggccctcgatcaggtcggcgaactggtcgtcacccgccccatgccgtccatgccgctgcacttctggaacgaccccgacggcagccgctaccacgacgcctacttccgcgcctaccccggtgtgtggcggcacggcgactggatcacgctcacctcgcacggctcggtgatcgtccacggccgctccgacgccacctcaaccgcaacggcgtgcgcctgggcagcgccgacatccccaccacacccaccggccgcaggctgtgatgaagagcccggggtgccggtgatcgtgcccttgttcagcggtctgacgatgccgctggagcggcgacaccccctgggccgtgcgttcacctgcgtccgacagggggacgggacataccgactccagggccccaaaattcgcacttctagaccaaaaggcctaataatgataaaaacctcatgtgtgaggcttttaccctacgaaggagctcgtccatgcctgcagttctgatccacggcgtccccgacacccaccgtgtgtgggacggcgtgcgccggcacctgatccggagcgacgtcgaggcttgggatctgcccggcttcggcacgccccggccgcgcggcttcggctccagcaaagaggagtgcgtcgattggctcgtcgaacggctggagcgggtgggcgagccggtggacctggtcggtcatgactggggctgcatcctcaccgcgcgcgtcgcttcgatacggccggacctggttcgtacgtgggccggcagtagcgctccggtcagtactcagtacgactggcatccgctggccaagatctggcaggacccggtcgagggcgaccggttcatggacgagcttgacccggcgtccttcgccaaggatctgatggagaacttcgatctcccggctgaggtggccgaggagatggtccggcgcgtagacgggaccatgagggacagcatcctcaagctgtaccgctccgccgagacggtgggcgcggagtgggaaccggaactgacgaatgtgtccgcgccgtccctggtcctgtgggggacgctcgaccccgcctgtccgatcgcgttcgccgatgaactcggtcaagctgtgcgagcgtcccaggtcgtcgaactcgactgcagccactggacgttgatccagaagccggccgaggtcgccgcagcccttgaggcgcactggaatgcctgaggagctgttgtctttccggcgagcgcgttttctccgagggggcatgggctcggtgattccgtgggagtggtggcctgtcgtgccgtcgatccccggggatgtcgcggatgtcgttggccgtcggactgccggatcagcacgaactcgccgcacgccgtcgagtcgcgggcgtgacggcaggagatgtagctcctgcgagcgttctcctgccgtccgacaccggtccctgtagtacccacctctctgttcaggcctccttgacaggcccttccgatatgactcgaggcagcaggagtaaagaccaatgaagtcgttgagaaccgaaattcaggggctgcatgtgcaacttgtcgtcccgcatgagatttccgcgcctgtgagcatgaggctgcggtacgagcctagtgatccctatgtcgtccgtgccgcattcactgctgtcgacagcgacgagacggtggaatggatcatcggacgagatcttctgatcgacgggctggaaggccccgtcggcgagggggacataagcatatggcccgccgacggtcctgaccgctccgactcgtacatccttctcaacccgccagctggtacggccttgctcaaagcccggacgcacgaaatcaagacgttcctgcagggaaccgaggacctggtgcccaggggagccgagccagggcacatcgacttggacacttcgctggcgcacttcctcgccgaaggatgaagtcggcccagctgccactcatcaagaggccggggcgctcgatgtccccgcctcaccgattcctgatagcgcgcccaccctgaggtgaattcatgctttcccttatggccgttgccgatcagaatgcgtcctcatcgatttctggtgcgggcttcctttcgatctgcgcattgctcttcaccatcgcatcgttctggtggctcaacgccagacaaggacgcctggagtcatgggagcctcattcctttgcagcgattgtccacggctccgtggttcgcctgcggcttccgctcgtccttcacaacaccggcgccaagccgatagtcgtgcaggacctcaggctgaccttccctgatgagtccgcctctcatctgccgcttctgtgggcgtcttcgccgtcccgtctccaacccgggccggacgaggaaccggaattgccggccggattcgttgtggccggcagacaagcgcgacgagttttcatcgagttcgaggcaccgttttctggtttggttccggcggcccgtgactacaaggtccgaatccaagtgagggttggccaccgcaaggggtggcgctcacttctgacgtacaccttgaggaccaccaacatcattcatcccgaccggtacaccgtctgcaacaacgcccctctcgaactgacgcaggaagactgcaaaaaggcagacgctgcgctcctggagctgttggaggggcacgagaagggcgcttccgccaagagtgagaccaagcggcgagactcttggaacgagggcaacgccgacacggacctgtaggtcgtgcggatggtgctgagctcggccaaagcgcaccgtgtcggcgagtcggcgcttccacatcgcccgcgagcacgcgcgcacctaccctgccttcgaccagcagaacttcgacctcaccgcttgatcacgagcctgcttgcggacagactgcggcccatgaagttcacgggcgtgcccgcctgcgcgcaggccaccggggtcgagacgggcctctctttgcagcggcaggctcagcagtgagcgtcagcctgccccacttccgctatcaccccgaccccgtcgccagcgggtccatcggcgagagcgccgaggtctgcgcctgctgcaaccgcagcacggggtggatctacacggcgaccttctacacggcccacgacgtcagcggcagcttctgtccctggtgcatcgccgacggcaccgccgctgaacggttcgaaggtgaattcaccgacccatacggcctcgacggcatcagtcaggagaccctggtgcaggtcacccgccgcacccccggcttgcacgcctggcaggatccgcactggcttgtccactgcaacgacgccgccgccttcatcggcgaagtcggatacaccgaactggcggcccaccccgaggcactcgaccagcttcgactcgaccttcggatgggcggttggaacgacgcgacccagctcgagcacttcctgacccacctcgggcagggggcaagcgccatgctcttccgctgcacagtctgcggcacccatctcgcctacgctgacgcttcatgacggcccagctcagcacacgcgttcccttccaaggatccgcagccaacgccgatcacacggcgctcgtcgccctgtcggaaaccccgggcgggcccatgcgtgcatatgagctcagcgatgagctgggctgggctgggagagagccgcctccaccaccagctcacccgcctgtgcaagcgcggcctggtggagcgccagagcggaccgtcacgcgccatgtatgcggcgctcacgccagaaggacgcacagccttggaagaagcagcccccaaagccatgcccaggtagtgcggcgcctgttcgtcgaccctctcacagcagagcagatcgaccatctcgccgagatctccagcgtcttccttgaccatctgcactggctggtgcggccagtccgacagcggctgaccactcgtcaggtgcggcaggcaatggcccgcttgccccagaccgtcgaggctgccgaagacgtcgtcgccttcgatgtgggagacccgcaggtcgtgaccgtggcgtgcgatcagttcgcgcgtcgcggcggccagcccggcggggtggagtcctccggcgttgacgacgagcctgatccggttggcgacgaggtgctcgcgcgccgcgtcgaggtgctgcaggaaggtgatcgcaaagcccttcgtgctgtccttggcgcgcgccttgccgaggaccagcatcgtgacctcggcgaggtattcacccgtgaggacgtcgatgccgcccgctcgggccatgtcggccatggccgaggcgcggtcgccgtagaagccggagcagttcccgacgcggagggggcgtcggccccgttctgatgctgacgtcatgccaaatcttccggtgtagaggagcgaagaccgccggcgttctctccttcggccctgctgacccgtaccgtcccttcgaaccccacttcgccggaggggtgttcctcggcgagctcaagggtcatgctgtcgccctcgatgtgggtcacccgcgcggcggaggccaggttggcgggcgcacagacgggcttacgcaggcggtaggcaaccttcgtcacgtgccacttggggccgagagcctcggtgacacaaggcaagcgccgctcgcaggtgggagtgcgccacgagaccgccgtggccctcctcgcgcgcgtagggctcgtcgaagtggatgcggtgggggttccaggtgaccgcgctgtagcggaacagctgaaaggtcgtgaccgtgtgcttgagccgtgggagtgtgtccccgacctgataattgatggacactacaactcctgcaaactcaagaaggcggtcgccgttctcggcgcccggtacgggctcaaccacgcctgatcccccgcgcggcccggctgtcgccctccggtgatgtccagtcggggcggcaaccgccggcgcccgactcaagggactcaccagcaggcaagtggtgtcgtcggcacgcattcctgtcggccgagcgcgggcgagaagtgtgtcggccatgtcgtccagcgggccggtggccttgcagagcgctgtcgcgaagggatcgtcctgctcggcgacttcgcctggtgcatggcccctgtactccgggcagggtttggcataggcatcgcgggcaccgaactgctggcccggctgctcgccgaacacgaccacctgcccgccgccctcggcgtgcgggagcaacggctgcgcccgttcgtcacccgccatcagggggaggccctgcgcatgcggcacttcttcatgcccgcccaccgcttcgggtacgccacccgccgcaccctcatccgcgcggccgacacccctgtcggctccgcgctcaccaagacccttgtgaactgaccgtccacacaaaaccgtgggcgccggtgctccctcaagcaccggcgcccactcacccctgcccgagtggtctggatgaactttctgttcagtcgtcaggggacgaggatgaggcggatcgggtcgccgatcttgttctccagccggttgaccgcgtcggcggcctcggcgagcgggaggtggtcggtgatggagggggccaggtcgagacggccgacctcggcgaggcggaccagctcggtgacggactcggggctgccgccgtagtggccgcgcacctgcttgcccaggtagttgaaggtcaggccctcggtgatggtgaggggcctggggctgatgccgaccaggatgaggactccgcccaggccgagtgcggcggcggcctgctcgcggacggccggcacgccggcgcagtcgaaggcgaagtcgaggcctcgtccggcggtggccgcgcggatctggtcggcgaagtcgtcggcggccgggtccagggcgaagtccgcgccgaaggccagggcgcgttcgcgggcgctgggcagcgggtcgacggcgatgatcggcgcggcgccggccaggcgggcgaggcgtacgttgtgcgcgccgactccgcccacgccccagacgccgacggactgggcggggcgcaccccggcggtggtgacgacggcggcgtagggggtggagaccgcgtcggggatgatcgcggcctggtcgaagggcaggttgtcggggatggggatgagggtgtcctcgcgggcgacggtgtactgggcccagccgccgtcgtagtcgatgccggcggtgcgcatctgagtgcagggtcggctgcgcacgcagccggcgcactggccgcaggtcttgccggcctccagggtgacgcgagtaccgacggtcaggccgcgcttgaggtcggggccgagggtgtggatcacaccggagacctcgtggccgacggtgaccgtgtcggaggtggcgaacagcgggacgagggagccgtcgatgaggtggacatccgagaggcagacgcctgcggccttgacctcgatgaggacctcgccggggccgggcacggggacggggacctcctccacggcgaacttcttgctgtccaggtggaagcgtccggcgagcatggtgtccatggtgctctgctttctgtgagcggcactccggcggttcgggccgacgggtgccgtgcggtgtctcgcgggtgaggggtggccgggaggggtgcgggcgtcaggagcaccgcacgcctcccggtgtctgagggtcaggcgaagacgtcctgctggtagcgctcgtccgcttccagctgggcgagccactgctgggcggcctcgtcgtcgctgccggtgtgctttcggtagatggcggcgagcgcctcgcgcacggcgggtgccatgcggcggccgtcaccgcagacgtagacgtacgcgccgtcctggatggcctgccacacggtgtcggcggcacccacaatggcgtcctggacgaaccgggccgggtgtccggtcaccgcggagaaggcggtgtgcacctgggcgatcccggcctgctcccagtcctgcatctcctgccggtagaagtagtcgtgctccgggtggcggcagccgacgaagacctgggacaggcccacctgggtgccgtgcgcgtgctggtgggcacgctcctccaggaagccgcgcagcggcgcgatgccggtgccggggccgatgaggagcagcggcgtggcggggtcggccggcggggcgaacgtcggggagggcacgcgcacgtagccgtagaagacgtcaccggactcgaggcctgcgatgtaggaggagcaggtgccgcggtaccggccgtcgccggacagggccgggccttccagcagaccgacggtcagccggacgtggcgcgggttggccagcggggaggaggagatggagtagaaccgcgggcggatcgggcccatcatctccaggaagaccgccagcggcagttcgaccgccgggaagcgctccagcaggttgagtacggagacccgcttgcccaggatctccttctggtagcgctcctcggcttcggcggtgtcggccgtgtaggcctgcagctgcggccgggtccacgggcactgggtgtgctcggccagctcctgtatctgagatcgggtggccacgtcctgcagctcgacgaactcggtgaacagcaggcctgtggtgacgggggtgcccaccgggaggtgggtccggccaccgccgggctggtcgagccggagcacctggtcgcggtcgacgccgagccgcgcgagggcgcggttgaccagcacgggctcgttcttggcgaagacggccaggtggttgccggtgtcataggtgacaccgtcggggagttcgatggtgatggacttcgcggccgggcgcggcggctcgatgctgaagtcccacagcccggtcgcgtcgctgaccagctcctcgttggcgaccacggtgagggggtaggcctgctccgagacgatcgcgggacgcacctccgcctcggtcagcagctgcacctcgaagcgcggcccggtggtttcggaggtgtcggcggcgtactcctcggccagggtggtccacagggtgtccatccagcgggtggccatgccgtcgaagtcaccggcggcgtccgcgataccgcgctcgatgacgcgggtggcgccggcggccagcaggcctgcctcgatccgcttggggaagccctggtaggtggccacccactgcgtgttgccggcacccagcagcgcgaaccgcacgttggacagcgagccctccgggagtccggcggcgagcaggtcgtcgaagcgctgcgcgttgtccggggccttgccgttgtagctggaggccacgacgacgagcaggccctcggtgggcaggttgtcacccaactcgtccaggccgaccagggtggtgccgaatccggagcgctcaccgcggtcggcgatggtgcgcgccaggtcctcgcacgagcccaggctggagccgtaggcgacggtcaggttcaccccgacaccgctgaccgcggcctgcgcctgcgtgtcgtcggtctgcaggtccgcggcgccgaacacggtccgctcgtgctcctgacgagcccgcacgttcagttcgaagccgccgggcttgcgcgtcagcgcctccttgacgtccatcttgtagtcgtcggtgtcggcgaacttgaacttctgcagaaccagcgcgagggccagacgcgcctcggtgagtgcgaactgccggccgatgcaggcacgcacaccgttgccgaacggcttgtaggcgtgcgggtggtggttgacccggttctccggcagccaccggttgatgtcgaactcctccggccgctcccacgccttggggtgggtgtgcagcggaccctcgaggatgttgacccgcgctcccttcttcagcccgtagcagccaccgatgacggtgtcctccagcggggacttgccgatcatcgggatgggagcccacaggcgcagggtctcctccaggatccgcgggatcacgtccatctgcatgatcgtgtcgtagtccgggaccgtgtcacccggcagcagtcggtccacctcggcgtaggcctgggccaggatgtgcgggttgcgcatcagcgagtacgtggcgaacgacagcagaccactggtggtctcgtgaccggcgatcaggaacgtcaccacctggtcacggacgttgtcgtcgtccagccccttgccggtctccgggtccgtggcctccagcatcaggcccagcaggtcgtcctcacctgtgcccttcccctcacggcgctccttgatcacattctcgaccaggtcccgcatcagccggatgttctcgcggtacttcttgtcatcggccttgcgcatcttggtcatcaccggcagctcctgcgagcgccgcagcgactcaaccagcgcctgcagcagcgcgttgaggaaggggtgcagatcctccttggcgaaggagtcgaaccggtaaccgaaacccgacagggcgatggtgtccagggtcagccgggtgtagtcgtcggtgatgttgacgggctggccctccttacgctcccacttgcccaccaggttctgggcgatctccagcatctgcccgaagtagcccttcatcgcccgctggctgaagaccgggaggaggactcggtgcgccatgccccattcctcttcgtgctggtgggccgtgaacaggccggctcccgcgtagtcccggacatgggccagcggcgtcttgtcgatctgcttgaagaaccgcgtctcgtcgcagacctcggccaccaggtccgggtcccagacgaagacctgctcgatgccggcgatctccatgccgtagagcccctcggggaactgcttggacagcttgccgaagtactccaccgggttggtgctggggatctgcggcgtgtggccgaagagcgggacgccccgcggagaccggatgggccgcaggtcggtctcgggctgtgtggtcatggctggctcctccaaggggaaaggcgggcagggcgccattcggtgtgacggggcgccggtacggcagcgccccgtttccatacgctgtatgccttcagtagtaccatacgacgtatggaaactcaatcggcagacctggggtcgagaaacaggaacgtttcggcccatcagggacggcgtcgctcacgcagcggggtcgcatcaggatcaggcgctgccgaacgctctcccggctggaggaggcgaggggagaccggtcgccgccagccggcggctcgaccgggccaccggtgggtgcgccccggggaggacacccacgatccgcgacggcggccgcggctacatcccggtgagcagccaatccccctgcccgccagtacgcatcgcggaggtcgggtctgcacccatgcgcgtcggcgactgacggcagcgccggagaagcaggcgcgtgtgccgcctcgcggcggcgcccgtacgtctccatgccgcgctcgatcaggccggtatcagtccgcgagagcgggcaaggcgggttcgccagggtctcctcggcagggcatatctgcgatccgccgccgcgggcgagcacaccgggagtgggagcggtcgacacgcctcgcccggtcctacgcccgcacacgtcaggcggcagtgcgctgaagccgccgctcgagcgccttgctgcacccctcgagcgcagcttcccgcctgagccttttcctggccgaggcatgccttgacgacctcgtcggccatcaaggccaccagttcgggactgcccgtcgccagttacgccgcccaccagcacacagcccgcttccgcgaaaccggaggaacgaggggctgaaaacgatgccaccgtcctccgcagtgccgcgggcgctggtaccgtacagcgtatggcgactgaacggaagccccctcggggcacaagaaagagagacgtaccgctcaccaaggacggcatctgcgccatggcgttgcagctcatcgacgccgacggggtcgaggcgctcaccatgcgcaaactcgcgaccgcgctcgatgcgaacccgatgtcgctgtaccaccacgtgccgaacaaggacgccgtgctgcgcggcgtggcccaccgggtcggttcgcagttcagcgcggggcagcgggaggacgtcccctggcaggaccagctgcgtgaactggcccgggacttccgcgaactgtcgcaccgtcatccgaaactgatggggtattccttcacgcgccccgactacgtgcagccggaggaccccttctggcaggcactgatcgacatcctggccgccgcgaaactgcccgacgaggagattccgcgcgtcgccgcgaccctggtcggtgtgttcacgggtctgctgctcggcgaactgaacggggcactgcagcggtgggccaccctgccaccggcaccgtcgggccccgacggggaagacgcgcccccgccctccaaggacgtgatcgacaccatgttcaactccgcgctggacgctgcggtctccggagtggagaaccatgtcgcacgagtccgcgagggggcgtgacggaaagggaacggttccgtggaggggcggtgcgcggtccggcggcgcccccgccgggccgacctgacgccgccgcgcgtgcttgtctctcgtcggcggcggccgggctcgcgtccggccgccgccctgtcctgtgtcaccgatgacacccactcagagaaccggctccggcctggccaagcaccggatcaccacacatggcgcctgaacggtgccgctgactgcccctcggtgtcagcgataccgaggccggcccccccccgttggcgaacccgagggcgggcaccttgttatgcagtccagtgcgcctcaagggctgcggcgacctcggccggcttctcgctccggatcaggtgccgacgcacgccgccccacacacggtgggtgtcgtggacgccgtggatcagaactacaggcacggctgaacccccttagcactgaacaaaaacagcacgtctgggcttttggccctcactgaacttccggatcgagaccggccgccatgcccgagacaggattccccggggactctccttcacagtgtgcggccggtggtcggagttgacgggggatgcgtccggaggcgcacccggagttctgcgggggctggccctcgcgcccaccggcgtgatcggctgtgagccggctttccaggccgctgatgatcgtgtccagcaccaggcggaacatccggtcctcgccaaagccctcgttcgtcgggccgtcctcgccggaggcgggtgtggcgggctggaggttcgaccaccggtgcagcgcgccgttgagctcggcgatcatcacgccgatgacgacggcgcacacgagcgcggcgagctgcgggatctccgactgcggcacccctgcggcggccagtacggcggtcagcgcgacccagaagggatcttcgggctggatgaagtccggctgactgaacgagtaggccatgaggttggggtggcggtgtgccagcgtccggaaatccgtggcaagcaggcgcacgcgctcctgccagggagcgtcctcgagtgtcacggtgcggaaccgggcgccgaccattctcgccacgccacccagcaatgcttccttgttcggcacgtggtggtacagcgacatcgggttcgcgtccagcgcggcggcgagtttgcgcatcgtgagtgcctcgaccccgtccgcgtcgatgagccgcagggcggaggtgcagatccctgcctcggtcagaggcacatccctcttccgagtacctctaggggtacgcttcgctctttccatacgatgtatactaacaagccgtacggcgtatggaaatctgcccgagtgaggccacgcgttccggcggccgggcgagggggactcgccgcccgtggcggcaaatagagcggaccatcgggtgcgaccgtcggcgttgcgggcgggagggctgacgcagacgttcgtccactgatactttccgccggacgcggttcaggcgctgctgtccaagcatctggtcgtggacgagtacgagggcgctgcctgagtggggctcattcccttggccatggcggactacgtacggcatccgaacgggctggagcgtgctggtcttcacgttccgatctcgaacgtgtagtgcgagggaacgaacaattccgagagcgccgtcgcatggtcgggtcacgacagggtggtgatgtcggcccagtggacggcgtggcctgcctcctgccagtcgccgtgtgcgtcggcgaggcaatcgatgatcagcagcccgcggccgtgttcgtcggcgtcgaggccggccgtccagtcgacctcggtcggcggcagggcctccgtcggccacctccacgtgcacatggccgtcggccgggttgccgtccagtccgaagctcagcggtggttgggcatgcagtacggagttgtgaagcgttgcgccctgaggccggcctgtggtcgggcgggcgcaggctgccgcgcacgaggaggcgcccatcacatcccgaaaagaccttctccacgcggccgacggcgtaaccgtcaggtcggctacagatcgatcgcccggcccagccgcagcaccggatcccgtgcgcgctctacgggcacatcctgccctacgccacctcgcgctcagttctactgctggttcgctcgcctggatggtgtgcgtggtccgcggtctcgtacggccccaggaatcgcagcatccggcagtggccaggccctggacgctgccgtgcggctcgctcgcactccggacgacgaccctgcgcatgactcggccggccgagctgcggcaacggcaacggcaacggcaacggcaacggcaacaacctggcgcacggcgccgccggtacgcgttcacccccggccggctgtgcctccgcgtcactgggcgtcggccgcccgtactgacgggcgctcaaccgggtcttcggcaactgcacccgtccccccgatctcgccgatctcgtccatgcccgttaccgtccggcgggcacctcggcggagttgcgcggcgttctggcacgaacgagaaggtcgacgcagacttcgaggggctcggtacctgtcaccgcaagggtgagtcggcggtgggcgtcagcacggactcggcgacgccgacgatctggctgatgtcgaagccctccatgtccgcccggaattcggggctggacaggtacgcctccagccgctcctgaacgtcgtcggcgtcccggtaagaaacgagggcgtacagctggggctcctcactcccgggggccgcaggcaccgtccaaacgccgtgtgtggtgatcctgtgcttggccataccgggaatgtgctgggaccagatgttctcgtaggcgacgagcgcctcagggctgcgcagggtgtagacacgaagctggtactgggacatgaactctcttccttctttttcgcggccggggcaaagagccccatccgcacggcggtgggaggcttctctcagccttttgcaaacaggttcgccacttctcggtcccagtcgatgtgtccggactcggtaccccgcggcacaagcgcctccgcgctctccaggaaggtcttgacgtcctgcacgggaacctcgagcaaggcggtgcccgcgggagccccgaggacgatgtacatcgctttgtcaccacggccgacggccggccagacccggatgtccccacagcctgcggaaccccttaggccatcggccagaagatcacgccccaggacccactcggtcggctcgtcggtgtgggtgaaaaaggtggcacggacgacataggggtcagtgggctcgtaccgcaggctcatacacatggacagcgagtaggtgcgcgagacgacaagctgcacggccacctcctgcatgacggtcttcaaagactccatcgactttcactcctgcctgggcggtggtcagcaaccgctgatctcatcccggccgtcgtggtgccagccgcggatctcgtcccaggagtagcccagttcgagcagatagccgacaccgtggtcccagcggtagtcgccggcgtcgacgctgacggccgggcgttggccgtgcacggatgcggaagtcgcggccgaagcggtacccccggcaccgagcgcggcgacacccgcgaccgccacgcagaaggcggtgacggcaacgcgcctcgtgagcctcttcatggtctttccttcctgatgggtgcggtccgcaccatcggctgcatgcaggcgatgtgcggcatctggcgcggcctgggcaaacccttccatacggcgtatggaagtactctcccagaattaccatacgacgtatggaactgtcgaggcggtgaaaccggcccgcacagtcggcagcggcatgaacagctcgacgtcctcacccagacagcgtcggccgcctggacgaagtccgcgtggccttcgagaagatgctcacccgcatcgaccatctcgggctctgcaccgaagagatcagccgcaccggccagcaactgggcatgttgtgcccgtgcgttcacccacccatccctcatcggcgtggccttcgggctcgacaacgccctgggttgagccgtcaccccagccggacgagctgccccggatttccgtctccggagccgtggcatgcggtcacccgggtccggccccatgctggaaacgagggggtgagacaacggagggagtggtggggatgcagaccgttgtggatctcacgcgctgccagggctatgcgcagtgcgtcttcctcgcgccggaggtgttccagctgcacggggaggagggcttgctgtacgccacagccgtccccgacgaccaggtcgagcgcgtgcgccaggccgcggcggcgtgcccggtgcaggcgatcctcctcggtgaggaggtgagcgccggtgcccggtgacctcaaggacggacgtatcgtcatcgtcggcgcgtcgctggcggggctcagggccgcggaggcgctgcgtgaggagggcttcaccggctcactgaccgtggtcggggacgagccccacccgccctacgaccggccgccgctgtccaagcaggtgctgctcggccaggcgacggcggacagcaccgggctgccgatgcgccaggacccgaacgccgattggcggctgggcgtgcgcgccaccggcgtggacctgctcgcgaaacaggtgctgctggaggacggcgagtcactgccgtacgaccggctgctcatcgccaccgggacccgcgcgcggccctggcccaacccggcggaagccgccctggacggggtgttcgccctgcgcacccgcgaggacgccggaggactggcgcagcggctgaccgccggtccggagcgcgtgctggtgatcggcggcggcttcacgggctcggagatcgcctcggcctgccgagaacggggactggaggtcacggtcgccgaacgcggccccgctcccctggtgggcgcgctcggcggcaccctgtcgaagctcgcggccgccatgcagcgcaaccacggcgtggacctgcgcaccggggtgacggtcaccgccctgaacggcaacggaagcttcaccggtgcggagctgtccgacggcagccgcgtcgacgccgacgtctgcgtcgtggcgctgggcgcggtacgcaacgtcgaatggctggcggagtccgggctggcggcgggcccgcgcgggatcgcctgcgacgccggatgccgagccttcaacatgtacggaatcgtcaccgacgacgtcttcgtggccggcgacgtctcccgcttcccccacccgctgttcggctaccagatgctctccctggaacactggggaaacgcggtcgagcaggccgaggtggcggcacacaacatggtcaacccggggcctctgcagcgcccgcacctggccgtcccgtcgttctggtcgacccagttcgggctcaacatcaaatcggtgggcgtgcccacctactccgaccacgtggtcatcgcccagggctccctggaggcgcgccggctggccatggtctacggctaccagggacgggtcaccgccgccgtcaccgtcgacatggccaaggcgctcgactactaccggcacctgatcgagacggccgctccgttcccgcctccgcccggcgcccaggaccgtgcggtcgcggccgacctcgcgattccgtccgacgtgccggatccgaaggggctgtcgcacggccccaccgtggcgctcaccggatacctgccggatcgccggctgacgctggtgcagcccggctgacccacgtccccgcccgaccacgaggagccaccatggcctccgacaccctgctggcccggatcaccgactacgccaaccgccccgacccctacccgctgtacgccgaactccgcgaggcggggcccgtggtgcggcaggcggacggcagctatctgatcggcacctaccacgagatcgtcgcgctgctgcacgacccccggatgagcgccgatccgcgctcgcgcaccgctcccgctccgtacgaggtgacacgaaaaccgtcgttccttcggctcgacgaccccgagcaccaccggctgcgcaactcggccatgcggccgttcggcccgccgcacagtccgggccgggtcgactccatgcgcggcgagatcgtccagctgaccaaggaactggcggaagtgttccaggagggcaggcagatcgacgtcgtcgacgacttcgcctacccactgcccgtgaccgtgatctgccgcctgctcggcatcccggacaaggacgagcagctcttccaggactggaccgataccctcgtcgcgtccgccgacatcgggcccgaaggtgacaccgccgaacgggaccaggcggccgaccaggcgcagcaggagatgggccagtacctggtccaactcgccgaacagcgccgcggtcggcccaccggcgacatgctctccgacctcgtcaacgaaccggacccggccgcacggctcagcgaggaggacctggcggcgaacaccatcctgctgttcatcgccggacacgagaccacggtcaatctgatcgccaacggcgtcctcaccctgttgcgccggcccgaccaactggaccgtctgcgcgaagaccccagcctgctgccgcgagcggtggaggaactgctgcgctacgagcccccggtccacatgcgcgagcgggttcccctcgtcgacatcgacgtcgccggcaccacgatccccggtggcacgtccgtcatcctggcgctggcctcgggcagccgcgacccgatgcggttcagcgaacccgaccggttcgaccccacccgcccggacaaccagcacgtcggcttcggcagcggtatccacctgtgcttcggcgcgccactcgcccgtatcgaagccgaggccgcgctcggcgcgctgctcccccacctcggcacggcacgcctggtccaggacccgcctccctaccggcagaacgccatgctgcgcggaccccgccacctgcccatccaactctgaggccgaggggcggcgacaacaggcgagagaggtcagccgccccggcccattacgcaggccgcgggagccggtgcgcggccgggacctcttcacgctgcggcgggaaggggccgccaggcgaggtcccgggcctcatccggggaaaggccgagcatatgcaggattgtctctgccattgcgcccgcggcctggtcactgtcggcctcgggctggttgcaccacagctccaggagcgccagcaggccgccgttcagcagggtcagggctatcaccgggtcggccacggtgaaccggcctgcggccatgccctgctccacgtcgcgcttcgcgcgcggagccagtccgtccccggcgtatatccgaccgagctggctgtgacacaggatctgcatgatctccgggtatgacgcggccatgcgcgcgctgagccgcacgcccccagcgacgcgctcggctggatcatcgacgccgtgcaggcgttcgtcgacggcttgggcgtactcctccagcgcatcggccacggccgcgtcgaacaggtccggcttgcccgcgaagtggttgtagaaggagccgaggcccacgtccgcgcgttccgcgatggcatggatgctggcgctggcgccaccggactcggccaggacctgccgcgcggcgcggacgagtgcctggcgggtctcggcacgacggcgttcgaatcggttcctgcgtggggctggcatcggcatgctccatgaataagagcagcagttctgatgtattcatcattgcaccatccgcctcaaccgtccaccctggcccaccaatcccgactccgcggttgcgtgatgcgacagcgcacggtcacatctggcaatttgatcaatttcgggggacttgacgataaagggatcgtatctgactatttcgtcagaagtggacaaagccgtccattgggccgacgccgcgcatgccgaggctgtcgcacacctcagcaccgatgggaagaaccggatgacgaagaccgaccacacgccactcgccgagccggtgagcccccgagagacacccgatgccgcaatagcgatgctcgacgcggaggggaccgtggtggggtggacgcacgccgctgagcagcttgtcgggtactcggccggggaagtggtgggccggtccgccacacacgtgctgccgcccgccgaggacgtcccgagtgcttcagtgttcgccgagcagggccgtgccctggatggctggtccggcgccgtgacggtccgccaccgcgacggccacgccatcaaaatgacgctgcggatctcgctgctgtgggggcaggacgccggaacccggtggctggtgtccgtgaccgacataggcaccctgtcctcggggacgtccgacgaagccgtgcgggagtcgctcctggcccacgcgccggtcggcatcgcggtctatgacccgcggctgcgctgcacctgggtcaacgacgtcatggagcgccacgacggcactcctcgtgagcgacggttcgggcgccgcctgcgggactcactgcccgccgtggaggccgaagcgctcgaggtggtgatgcggcaggtgctggagagcggcaccaccatggtccacgagtaccgggcgtggtcgtcgacggaccagcgccgggagcacgcgttctcggcctcgttcttctgcctccaggacgcggacggcacggcactggccgtgtgctcgatgagcgtggacgtcacgggcaaccggcgggcgcgcgagcgtcttgccatcctcagcgaagccagcacgcgcatcggcagcaccctcgaggtcatgcggaccgggcaggaactggccgacctcgccgtgcccctgctggccgaccacgcaatcgtcgacctgatggagtcggttccgttcggcgtggatccctcggcggggaccggcacggcggcgaacgaccgcccacctgtgctgcgccgtgccggtgtggcctccgtcgacccgggcatcctcaagttgctgatgcgccaagaggtgatccgccccttcccgacctcgctgttcgccaccgtcctgcgcacgggcaggtcttacctggaatcggtgctggacacctattcaggcccctggattcttcacgacccggcgcggacgcagatggtccgtgacagcggcgtccactctttgatggtcgtacccatccgtgcgcggcgctgtgcgctgggactggcggtgttctgccgctccgaggagccgacgccgttccaggaggacgacctcctgctcgcagaggaactcgtcacccgggccgcgctcagcctggacaacgctctccagtacgctcgccaacgcaccgcggccctgacgctccaacgcgacctgctcccccaccatgtgggaggtggcgccgccctcgatgtggcctcgcgctacgtgccggctgacatagaccacggcgtggggggcgactggttcgacgtgatcaagctgtccggcgccagggtggccctcgtcgtcggagatgtggtcggacacggcatcaacgccgcggtgacgatgggccgattgcgcaccgccgtccgcacgctcgcgaacatggaactgcctccgcacgaactgctggcgcacctcgatgacacggtcaagcggctgagcgaggaagacgccgacgctccggaccagctccccccggcggtgggcgccacgtgtctgtatgccgtctacgacccggtcacccggcggtgcacgatgtcgcgggccgggcatcccccgcccgcgatcatcgacccgcagggccgtgccactttccccgacatgcccgccggggccccgctcggcctcggcctcggtctggtccccttcgagtccgtggaactggaactgcccgagggcactctgctcgcgctctacaccgacggtctggtcgagtcccgcgacgacgacatcgacgtgggcctcgaccgcttgggcgccgccctggcagagtccggttcggccctggaagacctgtgctcccaggtgatcgagaccttgccgactcaggccccggccgacgatgtcaccttgctccttgcgcggactcgcggactcgaaccggcccaggtcgcctcctgggagctgccgaacgagccggccgccgtccgcatcgcccggcaggcagccgcccgtcagctcagcgaatgggggctcgatcatctggtgaccaccgagcagctgatcgtcagtgaactggtcaccaacgccatccgctacagcggcgggccgatccgcctacgactcatccagcaccaggtcttgacctgcgaagtctccgacagcaaccccagccacccacgcccccgtcagccccacaccatcgacgagaacggccgcggcctttccctcgtcgcccagttgtcccaccggtggggctcccgctccgcaaccgacggcaagatcgtctgggccgaacaagacctgccctccaaagccctcgcggcgtgacgcgctgcggcacgccgaccgggcggccgacagccgccacagcatgccgatctctcgagccgcacgctctcgtacaggaagccactgatggataaagagaatgccaagaacgcctactcggcaggcgcctcccaaggatcgacgggcgtctccggttccggtcccggcggcaggcgatgcgcctgtgacggcccggcagccgccgtgctcgacgatcgaggcgcggtggtggggtggaccgagacggcggaggacctgacggggttccgcgccggggaggtctgcggccgccccgtgcaggaactggtggccgacctcccggaccaccttcgcggcgccacggatatgccggaatccgggcgggtacggctgcggcaccagtgcggcgacaccatcgacgtcactttccggaccacaagggtgcagggctcggcgcaggtcctcgtcctggcggcacccacacaccacgtcgccgaccacaagcagggcacagcgctcctgcgcgcactgtccgcacagaaccggatcacgatcgccctgtacgacaccgacctggccactgtgcaaacgaacgccaagccggacactcccgacggccttccagtacagcccggcactcggctgagcgacgtgctgtgcgccgatgacgccgagaacctggaggcagtactgcgccaggtgctcgagacgggtgtcccggtggtccgcagaacccagcaagtgagctggcggcacaattcggcgcggcggcacacgctgtcgctgtctgcctttcgtctggaggacgtgcgagcacgccccacgggggtcgcagccctgtacatcgacagcgacgacctgcgtgcccgccgtcatctggatctcgcccgcgaggtggccgagcgagtaggaggatccctggatgtcgtgcgcaccgcacaggaccttgcggacgttctcgcacctgcgttcggggatctcgccgcagtcgaccttgcgtactccgttctcgacggggaagaaccctcgaagcagctgaacggtggaaacatgggcaacgcggcccttgcgccggccaccgcggtgtggccggccggcatcaagcgcggcgagtccatcccgccccttcccgaccaccccctgtggcgcagtttccgacacggcgagccagccgtcttcagccttgacgacttcatcgccatggtcggcgacccgcagctggtcaagtatctcgccccgaaggacgcccattcgatgatggtggcaccgttgcatgcccgcgggctcacgctcggcgccatatcggtctggcgctgcggccgatccgaccccttcaccgaggacgaggcggatctcatgaagcagatcgcctcacggggtgcgctcgccatcgacaacgcccgccgttacacgcgcgagcaccgggcggccgtagcgctgcagcagctcctccttcccccggccaccaccgacacgccggccgccgagaccgccggcgtccacctgcccgcaggcggggaagcggacatcagcggcgactggtacgacgccatcgctctgccctctctccggctggcacttgtcgccggagacgtggtcggccacggcatgtccgcaagcgccgccatgggcagcctgcgcgccgccatccggacgctcgcggacctggagctcgaaccggacgagctgctcacccggctcgcggacctggtccagcgcctcgcggccgaagccccgtccggcgactgcgacatcgtcggcggaacgtgcctgtacgcggtctacgacccggtcacccgccgctgcgccatggccagcgccgggcatccgccacccgtcctggtgcggcccgacgggaccgccgaagcagtcggtatctccccggggccaccactcgccctgagcggcatgccgtacgagaccaccatcatcgacgtcgagccgggcagcgtcctcgctctctacaccgacggcctggtcgaacggagcgatcgcgacatcggccaaggcctgcggcgcctgacggaagccctcgccgcgtactgccgtccggatcgcgccctggacgaaaccggccgtgctctcctcgccgatctggcagaccaggcgccgcgcgacgacggggccctactgctggcccgcacccgcgccgtcccagcggcggacaccgctcactgggagatcccggccgatcccgccgccgtcgcaaaggctcgagagtggacaacccgtcaactcaccttgtggggcctggacgacctcctcttcgccaccgaactcatcgtcagcgaactggtgaccaacgccatccgctacggtcgtccgccgatggacctccgtctgattcgccacaacgccctggtgtgcgaggtcaccgactccagcagcacccagccccgcctgcggcgtgcccgcacaaccgacgagggaggacgcggcctgttcctcgtcgctcaactcggcggacgatggggctgccgccacgtccagaacggcaagacgatctggtccgagcaagtcatccaggattcctcctgaagctacggctcacgaggccgctgccaccaccgagctggtcgtcagcgagccggtcaccaacgccatccgccacgcaagcgcccgatcgagctgcggctgatccacaacggcatgctgatcagtcgcacggctgtgtgagcggtgcacccggcacaccggagcgggaaagaccatctgggccgagcaacccgcccactgcacgctctcgactcgaccactgccccgctcgtcgctgcgtaccccgcaggctgggagcatgatgttgccgcgcggccggggtcggcggggcctggtgcgcccggaccgcgatggcactccactaccgctctgcgggaatgcggcggcgggtcgaccgttggtcagggccggctgggtgagcgatagggcagcgtctggctgtagacgacgctcgtggtcgtgctgccaaaaccagccagctcatccacgagcgtctccaagtgctccatggagctcgcggccaccttcaaggtgtaacagtcgtcgccggtggtgcgcaggcactccaggatctccccccgctcggcgagcagccgacgcaacggctggtggcggttgccggggtacttcagccggacgacggcgagcacgggatagccgaccttggccaggtcgaccacggcgtggtaaccggtgatgacgcccaacgactccagattccgcacccgttccgtggtggccgaggagctgagattcacgcgccgtcccaactcgctgagggagatgcgagcctcccgttgcagctgcccgatgatcgcccagtcaacgtcgtcaagattcacggccatgtcgcgactctaccggcagaaccacggaagaacgtcgccatcgccgggaagattcggttccgtatgccatgatctcctggataacctcggctcatgcaacttggcgtcaacgtaccgaacttcgggcccggaaccgatcccggcgtactgcgcgattgggcgcggctcgctgaggggctcggcttcgacctcctcatggtgtcggaccacgtggccgtcaccccggacgtggccgagcggtacccggagccgttctacgagccgttcaccacgctgtcctggctggctggcctcaccacgaggctgcggctgggcaccacggtgctcgtcctgccctaccggcatccgctgctggtggctcggatggctgccaacctcaaccaactcagcagcggccggttcgtcctcggggtaggcgtcggctgggcgcgtcaggagttcgacgcgctcggcgttccgttcaccgcgcgcggccgactggccgacgagtacctgggtgccctgcgggatgcctggcgcacggagaccggggacggcaccgccccgatacctgtctgggtcggcggccacagcgaggcggcaatccgacgcacggtcaggttcggcgacgcctggcacccgctgcggctccccctccccctgatgcgctcagtcctggcgaaccactcgctgccggcgttcgcgccccggatcgccctgcggatgaccggcacaccggtcgacgaccgcgagcggcccgccggtgtcggcaccatcgagcagatcctcgacgacctcgaccagctccgtctgctcggcgcggccaccgtcgtactcgacccctaccacggagatccggaggagacccgccggccccacgcggcctggcaggcactcaccgccgtggccacacactggaggaccccatcgtgatcaccattgaggacgagaccctcctgcggcgtgccatcggcatcgcggcccacgcggtcaccctgggggacgcaccgtacggctccctgctgaccggcccggacggcgcgatccttgccgaagcccacaacacggtacggcgcgacaacgacatcgccgcccacccggaactgaagctcgcccgctgggcggcccgcgaactcgccccggccgcggccgcccgcaccaccatgtacaccagctgccagccctgcaccatgtgcgccggcggcatcgtccgctccggcatcggccgggtcgtctacgcgctctccaccgagcaactcgtcgaactcaacccgcagtcgggcgactggccgacggtgccccaggacggcccggtcctcttcgaggaggcgcgcgcccccatcgacgcctactaccgacccacctgatgacatcggctcgtcaaactgttcgagccggtcgagcgcgacacgcgcgaggttcgccaggccgcgcttcacgtgtgcccggagatgctcgaccgtgccccagcgaccgccttgggagtcagtagtcggaaggcgggagcagtgtgccgagggggccgagatcaatattgaggtcctgcatggtcaggccgtagcgaccgcaaaggtcgttcaagcggtcgtgcaggaccatcagggtcatcccgaggcgctcttcctcctcctcggtgaggtcgccggcatccacgcggtgcagggcttgtcgttccatgagctgacggatgagttcgaccagggtgagtaccagcttgatcagatctcgttccacggtgtcggggtcggtattgatccgggaggccggatggggtgggctctcgttgcccgacgcggggacgtcctgcggagcggcggggaacaggcggaagggaccgggagccgcgtcggccgcctcgtcggagcggccttggtgacggggggtgtcgggcgtcatggtgaggggagctggtcggggtggccgggtgacgtgaccgggagcggcccaccacggctccaggggcttggggtcgtggtgccgatggaggcgatgagggctcgcagggagatccgtacgaggtcgatgtcggcgatcgacaaggtgacatcgccggtgatgacgatgccaccggtgagcaggcggtccaggaggtcgatgagcgcgacctggcggtcaggcagggacccgcggtccggtgggcggggcttcgcagggccgaaatcggaggggtcggtcatcatcaggtgatcgcctcctcgctcatttcacccggctcgttctgccgggagacgaaggagtacggcgcccacggtccggtgatctcgacgcggatggtctcggactgctcggcggccagctggaccgcgtcccggaagtcctcggcctggccgtcggccaccaggtaggcgttgttcactatgttctcgccggagccgtgggagagggggccttgctgcaggcggtgccggacgtgttcgacggcctgggtacgggccgcggcctcgacgcgtcgcgcggcctgctccgcggctcggtaggcgtcctgtcgtgagtcccgttcctgatggcggctacgcaggtaggcccggccgggactcagttcggccgcgggtgcggccgctgtggaggccgtaggggccgaggggggatcgaaatagactttgactccccattccatgtggccggcgaggtgggcgaggcgctgcgcgaacgcgcggtgaccggctctgatcatggcgcggacgcggtcgtcgtcgcgatagatggtcgcaagtcgcaagggcaggacggtggtccgggccgccatcgcgtcgacaacccggtggtgtgcccgggccacggcctccagccagtcgagatcctccaggtgagcggcgagcggtgcctcgtcgaagtcgtcggccgggacactactgacgatcgctgccaggttcgcgtcttcgtccggcaccagccgcactggcgcgtcggcgattcctcgcagggcggccaccacgtcgtacgagccgccagggaccgccgacacgccgtacaggtagctgaccgtcgccgtcatcgctctgtcctcggtgtccgccggttgccggcgcgggtggacttggccgtactggcacgcttcttgggacgctcgggtttctcagcggggccctcggccgacggaagggcctgggcgtcgcgcaggccagctatctcttcacgcagtcttcggttctcctcggccagctcacggccgccgtcagcgtgggaggacagggccgggtcgtgttcccaccagtcgatgcccatttccttggccttgtcgaccgaggccacgaggagacgcagcttgatggtgagcagttcgatgtcgaggaggttgatctgaatgtcacccgcgatgacgatgcccttgtccagtacgcgttccaggatgtcggccaggttggccgaggagccctggccgtaggacggggacgcccgggaggggaaggagccgaggttgctcgggacaggttcggtcacggccgttcagacctcgattcggcgtcggcggtgtcggtcagcgccgactcgcggcacggcgcggacgttctctgcgtacggggctccgcgtcgtgcccctcttcggcttcctcgtagaggcaaccgaagaggagcaccgcgcctgctgcggcattcatcatcgtgggggctcctcctgacacctcctggtccgcacatccaccgcccgctgagaacctcatgctccggtgccctcccggaagcgagtgatctcttcgagccggtccagcagctcgtcctcacgtcggtcgaaggtctcctgatcgatctggccggacaccagtgcccgttccagttcggcgagttccttcagcaccggatcggggtcgtagtactgctcttccgcgacctgcgccacctgctgcatgacccacccgacgcctcggacgggggccagcgggagagtcagcaggtgagtcaacagtcccatgacagatctccacgcacttacgttgcctcgacgaagctgtagggcggcagcggcccgtgcagacggaagtcgaagtccgctccgcgctcgttcgccagatcctgctccgcggccgtgaagccctcctgccgggccttgtccacaaggaacgagacgctcacgaagtcaccgcctttcggatccgaagcccggatgtcgcgtgccaggggacgcagcgcttcgacggctcccgcggcaaaggactcgtggcgcaactggacctccccagctacccgttcgcccagcgcgatctgcagatccgggccggcccggccgctgcggatctgctcgttcagctggtgggcctcgggtgattgcagcaggatctcccgcagcagcgcgtcctcgtcgcaggatgccttcaggtggaactccacacagccgtccagggccgtcagccgctcctgatacgaggcggctcgctcatccagcacctggagcaccgcttgatcgtcggaggtcaccgctccgaaacgcaggggcagcacactgccctcggccatcagccgttccagcaccgcctcatgcgccaggacgtcgcgccgcttggctctgagcccgtccggcgcatcgctgaccaccgctgccagcgaccgactgttcacggtgcgcagcttctccggcggttctcccacgccggtgacgccgtccaggcgtagggggtggctcgcggctgtgatggcgtagacatagacggccatggctcactcttcccggcgccgagcagggcggcgcgtcggccgtggcctcttccgctccgctgccggctcgcgctcttcctctcggtcctcctcatgcccctggtggaacgactccgtgacggcctccaccgcgccggtgagggcgcccttgctctttcccttggctccgccttcggtgacctctccgacgaggtcggtcagctgtgccggggctttgcgcccgctctccagatcgagcctgttgcaggcctcggcgaagcgcaggtaggtatcgacgctggccaccaccacacgggcgtcgatcttcaggatctcgatgcccaccagcgaaacgcgggcgaagacgtcgatgacgagcccgcgatccaggaccagttccaggacgtcgtacagcgttcccgagccgccgccctgggcgacgccgcctccaccgctttgcggcaccacagtcatggtgcctcctttcatgaggccgccgccggcgcggccccgtccggctccgttcacctacgggatgcacagccgtgtattcaccacggggagacagccctgtggcggggccctcaggcacgccggtcgacctgggcgcgtgtgtaccggcggatccgctcgtacgccatcagctcgccatccgcgtcgagcgtcacccggtagctggccatcacgctggtcgtctcaggtatgcgctcgatctccagcacctccacctcggcttcccatccgtcatcggtgggccgaaccgctgagacggattccggcgcctttcccagcagctccttcagctgctgcatcgccgagagcatggctcgcgacgctgaaagccgctgcgaggggcgcgggctctcacctcggctgcggacgcgagactcctcggtcccgcgatgcgtgcgcttacggggcctcgcgctatcgccgtttcgatccgcaggcatgttccgctcaaatacctcaattattgaaataggatctcaaattgcattctatcggatctcgcgatatgcggctcggcgcctgcatgaaggcgtccgcctgcacggagcaggcgaaggggaggcggcggtctcccggcgttgcaggagccttgctactggcacggggacgcagtacgcacagaaaggtaccgacgatcagagccgtcgctggaccgagcacggtggcattcgacggtgccccgccagtgccgtgccgcggcgggcgagagtcggcacgccgcggtgaactgcgctgacaggccgtcagcccccggcccgtcgcggcggacgacggtgccgggcgatgccgatccatcccgccggtgacagcacccgctccctggtgaaggacgaaccgcacccggcctggctgagggaactgcggcggcagggaaccgtcctggctagcgtgtgcaccggctcgctcgtccttgcggccgccggtttgccggcgggccggcaggccaccacccaccgggaccacctcggcaagctcgcaaggatcgacggcgcgtcaccgctctgcgggcgcgggctcggcctcccggtccagggcgagcggctcggcggcataggtgatgcggacgacgccgtcggcatgccgctccgtggcgccccgtacgccgaagacctctcgcaggaggtccggtgtcaggacctccagcacgggtcccgccgcgaccaccgcgccttcgtggagcacgacgaggtggtcgcagagtcgggcggcgaggtcgaggtcgtgcaggaccgccagggtggtgatgccggtgctgcggatcaggtccaggagttcgaaccgggcgcggatgtcgaggtggttggtgagttcgtccaggaccagaagctgcggacgctgggcgagggcacgggccagcaggacgcgctggcgttcgccgccggacagggtggcgtagtcccggtccgcgaaggggccgactccgcagcgttcgaccgcctcggtcacggcctcgcggtcctcggcgccgtcccgacccatcaggccgtgatggggcgtacgtcccagggcgacgatctcggttacggtcaggccggtcgtggtgccggcgtcctggagaacggccgccgtgcggcgggcggcggtacgagcagacagctcccatacgtcgtcgccgccgaccctgaccacgccgtcggccgggcgcagcgagcggtagaccgtacggagcagggtggacttgccgctgccgttggggcccacgagtccgacgatgtcgcccttggcggcctccagctgcacatcgcggaggatcggcttgcggtccagggtgatgtggagctggtccacggtcagtttcatacggtgtccaggcccttgtcgcggcgcagcagccacaggaagaagggggcgccgagcagagcggtgaggatgcccagcggcagttcgttggggcggttgacggtgcgggagagcaggtcgacgaggacgaggtacacggcgcccaggagtgcggtcaggggcagcagtctgcggtggtccgctccggtggtgaggcggaccaggtgggggatcatcaggccgacgaagccgacgccacccgctacggcgatgacggtgccggtgagcagcgcgctgatcaccaggaggacggcgcgcagccggttgacgtccaccccgagcgcggtggcggactcgtcaccggccagcagggcgttgaggcggcggccgaacagggtcagcacgacggtgctcgtcaggaccaccgccgtgacggtgggcagttggctccactgggcgccggcgacgctgccgagcatccagaacatcacggtccgcagctcggtgggcgtcgccagcagttggacgaagctcgtcacggacagcaggacatagccgaccgcgacccccgccaggaccagccgggtgggggccagccggccctgacgttgccccagggcgaagaccagtgccccggcggccagtgcgccgacgaatgccgcgcccgacacgccgagaccggccagcccgccgagtgcgacgccgccgagggtgatgaccagcacggcgccgagcgaggcgccgtaggagaagccgaggacgaccgggtcggcgagcgggttggagaccagggtctggagcaccgctccggcgacggccagtcccgcgccgaccagggcggccagggcgacgcgaggagcccggaaggtccacacgatctggtccagcgccgggtcaccggcggctccccgcccggtgacgtggtgcaggagaatgccccacacatccgccaccgggatgttcaccgctccgatactcaccgccaccaccatcacggcgacgaggacgagaagcaggccgacgacggcgagcggcagccgcaggcggctcgggctcagaacttgtcggggtgcagagccttggcgatcttctcgacggccaggtcgttgctggggccgaggtacatcgagtcggacagggccacgtacgtgttgttcttcgcggccggccactgggggaactccttcagcagtttcttggcgtaggccgccgggttcgggtcgttgtagccgatgacgacgagcgcgtcgacatcggtggcggccaccttctccttgctcaggtcggcgaaggaggtcttggaggccgacgcgaaggcgttgctgccgccggccttggcgaggatgtcgttgtagatgcccttggcgacgaccgagctgaagtcgttgccgcccatggccatgttggagaacagaaccatgaccttcggctgcttctcgcccttgaccttggcggagatctcggcgatgtgcttctccgacgcggcgatcagctgctctgcgcggtcacggacgttgaagatcttgcccatgtcgcgcagcagcgtgtagctgtcggcgacggtcatcttggaggtgtcctggtcgcagccctgcggggagacgtaggtgtgggcgcccacctccttgagctggtcgcgggtggcgaagccgttcttctcgtcgaagccgtacgacgtcgtggacagcaccaggtccggccgcagcccgatcatcgcctcgcgcgggatgtcgtaggcgtcgttgagcttgaccttgccgttgggcagggccttgatggccttggcgcggccggggacctcggacattccgtagctctgctggttggcgacgacgcggtcgccgaggccgagggagagcagcgtggagacctcggcgaccgaggcgccgttcatgacgacgactcggccgggcgccttggtgaacttctcggacactccgcagttctcgaggatcgccggataaccggacttcgcggcggccgcggacgccttgtcgccggtggcgccgtcctggtcggtcgacgagtcggcgcatgccgccgtgaccagacagagggcgccggccagggcgacggcgaccggccgtttcttcgacatgctggctccttgctgcggggtgttcgtgaggcggtgggttctgttgcagtagtcggggggtgcagcccgtgagttcccggagatgcccaactactttgccggggttgcgagatggctctgcttcccggccggggcgggcagcgttccggtggtgacgcagtggtcgaggtaacggaagacgaggtcacggtcgacgggcggggaggtgatgccgctgccgtgcaggccgttcacgacgttgtcggcacggacgcgtcccaggcgtagctccggcccggtcgcgtcgtcggggttcgcctcccaggcgtcgaagaaggcgagcatggtcgccgccacgccggagtcaccggaggatcgcggcagttcggcacgccactgggccagcggcatgcgccgcagcggatagccgtagtcctccagccagtcgtagacgtcggccagccgcaccgggcgggcggtggcgtggttgaaaaccgtcgctcccggcgggcgctgtccgaggcagaggtggacgagggcctgggcgacgtggtcgacgggtgtccatgtctcctcgtcgaacaggtcggggacgatgcgcgcggggatccccgcgcgcagcacgctccagaggaagtcccgttcgttcacgtagccagtggtgcgtgggccgacgatccggccgagccggtgcacggtgaccggcaggcctctttcggcggcctgttccagcaggcgctcggccgcccacttcgactgctggtagccgtggcgcagtccggggtgggccgcaaggaacgcctccggtacctccggggcgaggtcgaggggcggggcgacggagagggtcgacaccaagtgcaggggaatggagcgcacagccgccatgcgcagcaggtcccgggtggactcggtgttggcggcgcggagggtggcgtattcgcgcatgatgctgacggtcgccgcgttgtggatgatcgccccgcaggtccgggcgaggtcggcgaagagtgcctcgtccacgccgaggcgggggcgggcgaggtcggcggggaccgctgtgatgcgttcgcgcgccgcgtccgggaggtggatcaggtgggtttccagggcctggtggatgcgggcggtggcctcggcggggctagcggcgcgcacggtgcagacggcctccgcgccggtgctcgtcaggagttcggccagcagatgtgcgccgacgaagccggtggctccggtgagcaggattctgtccggcgtgccgctcgcccggggaccgtcgccggggcggatgtccggatcgaggacggtgtcggcgagcagggccgccggaaggccgggaggggccgagcgaggctgctcctgctgttccaggaatctcgccagttcggccggggtcgggtgctggaagagccaggcgactttgaggtcacggtgcagttcgacgccgaggcggttggcgacctggatggcctggagcgagtgggcccccaggtcgaacacatcgtcccgggcaaagacggcggccacgccgagcacctgttgccagacggcggcgatggtgcgcaccagtgcactgtcggacgtcgcggcctgcgcaccgggctccggcacatgtccgtcgggggtcgtcgcggcgagcgcgttcctgtcgatcttccctgagctcgtccggggcaggcggtcaaggaactcgacggccgacgggatcatggccgcgggcagcgtctcccggaggtggtccctgatcagggccacggccggggcgggcccgtccgggacgacgtacgcgaccaggcgccgcgtcccgtcgcccagcaccagccctacgacaaccgcgtcacggactcgcggatggccaaggagggcgccctcgacttcggccgggtgcactcgatgtccgctgatcttgaactcggtgtccgaccggcccaggtagcgcagctgcccgtcgtcgccgatccgtaccaggtcgcctgtgcggtaggcgcggggcgctccggggatctggtccagaggggcgaagcgggaggtgtccggtggccggtctccgcggtagccgatggccaggttgtcgcccaggaggtggagttcgccgtcgacgaccgcggctcgggtgccaggcagcggcagtccgatcgggacgtctcccggagcgagcgaggggtcgtggaggtcggcgacggtggcgaccacggtggcctcggtcggcccataggtgttcagcagccggaccgacgtgccgacggccgtgcgccagcgttcgacccgctcggggagggccgcctcaccgccgatgacgacggtgcgcacctcggccggcagagtgaccgcaccggtcgaaacggcgtacgccagttcgtgccagtaggccgtaggcaggtcgaggaagctgatccgcagccgtgcgcaggcgtccaggaatccggggaccgactcggtcatgtcgtcggtacggacgacgagcgtggcgcccgcacacagtgtgaggaagatttcctcgaggctggtgtcgaagtgcaggggggcgaactgcaggacgcggtcccggtggtgaaggccgtagcggtgcgtggcgccggcgacgaagtgcgcgagggcgtggtggccgacttcgacgcccttggggcgccccgtggagcccgaggtgtggaggacgtaggcgaggtcctcgggcgtcggtgccgtcgactgggccgcttcggaatctggtcccggctcgtcgtgtcgcagaacggcccggtccccgaagcggtcggcgaaggcgctggtggtgaggacgaggtcgggccgggcgtcgtccagcagttccgccctgcgggcccggggcgccgtcgggtcgagcgggctgtaggcggcaccggacagcaggactccgaggatggcggtgatcgcgtcgataccgcgcggcagggcgacggccaccaggtcgccgtggccgacctgacgggcagccagtcggcgcgcgagtgcacgcgccgatccgaagagtcgggcatacgtgatgctggtgccgccgtgctcgacggcgacgaatccgccatgccgggcggcatggtcggcgatcaggccgagaaccgggcgcacggggccgggcagcggcccaccgtccaggaccgggacgggctcgcgcgcacacaggtcgccgagcgcccggtcaggggccgcgacggcctcctcgagcagggctagcagcccctcctggagtgcggcgacgtccgcctcgtcgtagaggtcggggttggcgtccacggcgatgcgcagtcccgcgccctcggaacggtcgtagacgttgacggacaggtcgtcgacggggcccgcggagatattgtggaccgtgctccggtgtccggcgaagcgcaggtcgtactcgaagggcatgatgttgacgccaggaccggagagccggcgctgtccgccgacgagcttgaggtcgcgccgcagctgttcgtagcggtagcgctggtgcggcagcccggcgcgcagctcgcgggagatgcgggccgcgaggtcgcgcaggctgtccgaggcggtgacggcgacgcgcaggggcaggatgttgcgcaccatgcagggaacgcgcagggacacagagcccagacgtcccatcgccggcaggctgaggacgatctccggtgcacgggtcgcgtggtgcagctgggccacggtcacggccaacagcacctcggaccaggtgagttggaggtcccgggcaacggcacgcagggcctgcgtctgcgccgcgtcgaggtccgccactcgccggtggaacgtgcgcgcgggcagggccgtacggccggcgggagtggccacgggcggccggtccgcgaaccggtccgcccagtaggcgcgggccttggcgaagcggggcgactcccggtaggcgcgttcctcgtcccgcaccgaggccagcgtgccgaagccgccggccgccgcccgctcgcccgccgccagggccgtgtagacctgggcgactcggcgggcgaccagcgacaggccgaagccgtcgagggcgatgtggtgcacgcggtggtaccagaggtactgctccggcgcggtgcgcagcagggcgtggccgaagacggggccgcgcgcgaggtcgacggggcgggccatgtcctcgcccatccaggccagggccgccgcgtgcggattgggctcggtggtgaggtcggccgtgtgcaggcgccagtcgccgaccggggcggttgcctgccaggggcggccctggtcgtcgacgacgaagacgacgttcagggcctccgtctcggcgaccacgtggtgcagggccgcatcgaagacggccgtgtccaccggtccttcgatgagcacgtactcggccgtgttgtacgcgggactgtccgggtcgagctgctggccggtccagatgccttcctgagcggccagcaacggatgacgccgcgctgtgtcatccatgtcgctgtcatgcgtcggcatggtccgctcccctctgccgtgcggagagcagttgccaccactgggcgaacgaggtgcactcggcgagttcgacgaaggtcacgtcggcgccggtctcccgccaccgttcgaggagggtgacgatgcgcagggagtccagtcccgcgtccatggggttctcttcgaggtcgacttcgtcgggccgctggtacaggaactccgccaggtccgcgcggaagccctccagcgtgaggggagcaggcatgtcgttctctctcgttcgggcctggtggaaggtcagttgaccttgcgtgcggagtcgtcccagaagcggtcgcgcagctcgcggcgcaggatctttccgctggggttgcgcgggacgctctcgatgaactcgtagcgggcgggcagcttgaagctcgcgagccgcgggacgaggaaggtgtgcaggtcccgggggctgggccgctgtccgggcgcggggacgacgaaggcgtgcacgtactcgccccagcgttcgtcgggggcgccgacgacgacggcctccgctacgccggggtggtgctccagtacgttctcgatctcggcggggtagacgttctcgccggcgacgaggatggcgtccttgatgcggtcgcggatgaagatgtagccgtcctcgtcgatatagccggcgtccccggtgtggatccagccgtcgacgagggtctcggcggtcttgccgggcagtccccagtactcgaccatgtgggccggcgtggccagacagacctccccgaccgcgcccggcggcagttcgcgcccctcgccgtcgatcaccttgctgcccacacccggatacggccgcccggccgcctgcatgagggaaccgccggggacatgggcggccgggggcaggcacacagcggtgttgccggtctcggtgaggccgtagatctgggcgaactcgcagtcgagaacggcgaggctctcctcaagcagtgcctcggagatcggggagccgccgtagacggtcttgcgcagggtggtgaagtccttggcgctgacgcggggttcggtcagcatcatgcggagcatcgccgggacgacgcaggcggtggtgatgccgaggtcgcggatgaggtcgacggcctggcgggcggcgaaggcccgcatcgcgacgatcgtggttccggcgttgaagttctgtgtggcccaccacagaccgccgatgtggaatccggggataccgatcagcgcgatgtcgcctgcgcgccagtcgatccagtccagcccctcgctcgccagcgcgtcacggatcgcgaagaagctgcggtgggcgaggacgacgcccttgggcagtccggtggtgccgctggtgtagagctgggcgacgggggtgtcgggggtgacgtgcggtgtcgggtcggtgtcggggtgggatgccttccaggcgacgaagggctctccgagcccgacgaccgtttcggggggtgcggtcggcatcttctcgacgatcggcccgaactcctcctccaggaaaagcagtcgggtcccggagtcccgcaggatatggctgacctcgggcgcggtcagccgccagttgacgggtacgagcacggtgccgctcttggcacagccgaagaggatctcgtagtagtgctcggactccttgccgaggtacgcgacccggtcgcccggcgtgagtccggcggcctggacggcgtgggcgatgcggttgctctctcggtgcagttgctcgtacgtgaccgtgcggccctcgaagagaaccgcgggggtcgtgggctggttccgtgcgtggaagctcgtggtctggacgagcgtctgaagctccggatggtggagcctgtccatggccatggaggtctcggtcctctcttgccgctgggtgggtggcaggagcgcgtcaggggatgttgacgaacgccaggacggcctcgccgtcgcaccggcccgagtcggcgtcccagtagcggtaggcggtctcggcgtgcaggaacgggatgccgcctgcgggggcgcgccgggtgacggactgaaattccatctccccggagaatgcacgtgggttgacgggccgccggaagttggaggcgaagcgggcgatcaggatgtccgggagctgatgcttccagaagtcgtccagcgtccaggattcgaaccccgccaggagcccttctttcacggacttggcgacgaggtagtacatcatctggttgtagcagatgttcacctcgacggaattcagatggccggtgtcgtcgatatagcacgactccggaatcgcgaactcgcagcgggcgacggcccgtccggtgtcgctctcggtcacgacggccgagcgcagatacttgcagtggtccttgtagggcaccagcacgcgcgccaacaggtcctcgtccgtggggtgctgggccgtcgtcatgccaccttgatcccgtcgtgtagctttcgctcgtcgtgcacggtgacccggtaggagacggtcggctcgggggtggtcgtgtgccgggcgcggtggatgaggctgcggttgtcccagaccagcaggtcgccctgctcgaagctctgcaggtggatgttgtcgtgctcgaaggtctcgtcgagctggccggtggcctggaacagtcgcttgagcagctcgtcgtcgagcggctcgccgtcctggtcctcgacgccgatggtgaagccctcgctgatgtagaggaccgtctccccggtcatggggtgcgtgaacgtggtcggctggacgacggccggggtcttccgctcgacctcctcgatgatctccgagatggggcggtagacgtcgtggggccggatcttgaaatatttgcgcaccgagtgccggcagtacgttccgccgatctccttcttgagatcttcgggcagcctgtcgtatgcccggcccatgtcgatgaaatacgtgccgcggttctgccgcggaatgacctgggggtagatcagggtgatcccgaaggggtcaggcatgaactggtagtccgcgtgccagaactttccggtcttcggtacgcctatctgctttccgttctccggcacgttggaggatacgaatatctccgtgacctccgggtggtggtacatcggctcgtagtaggtctcggggcgccccagccgcttgccgagttcgaggaactcctggggagagaggtcctggcccttcaggacggcgatcttcttcgtgtagacggtgcttttgagtgcggcgatgtcggcgtccgaggcggtggcgtggtcgaagccctcgaccgtcgcgccgatcgcggtgccgggccgttcattgatccgcatgggtgccgcctttcgtggagtgggaggagaggaggtcagacggttgcctggcgggcgtcgacgagtccggcgagatcgccgagggtgaggtcgggctggagttcgtcatcgccgacggcgactccgaggtcgcgttcgatgcggatgctgatctcgaccgtcgtcagcgagtcgacgtccagttcgccgagggtcgcctcggggcggatccggtccgccggggcgtcgtgcaacctcgcgaggatgtcgaccagtcggtcgtaggtggtgctcatgacgtcgtccgttctccttgggcgtgcgggtcgtacggtggggccggcgcggggagcgtgggccaggtcaggaggcaggagccccaggtgaggccgcctccgaaggcggtgagcagaacccggtcgccgggccggagtgtctgtccggcggccgcgtcggcaagggcgagcgggatggacgcggcgcccgtgttgccgacggactcgacatgtgtcacgcagcgctcccgtgggagaccgaggtcgtcggccaccgagtgcaggatccgcagattggcctggtggggtacgaagtggtcgacgtcgtcggtcttccagccggcccgggacagtgtggcgcgcgccgactcggccatgcgcgtcaccgcgtggcggtagacctccttgccccgcatgccgaagtgccggtcctggcgactgggttcgcccggacgggagcgctgtcgggagccgccggccgcgaccatgatcaggtcctcgtgagcgccgtcgctgccgaggtcgaagtggccgaccgcgccgggctcgtcggggtgtccggcgcgcaggacgacggctcccgcgccgtcgccgaagatgatcgcgttggcccggtcgaggggatccacgatcgtggagtaggtgtccgccccgatgagcagcacccgttcggccacgccggccgcgatgagtccggcggccgaggcgaggccgtagacgaacccggtgcacacggcgctgatgtcgaaggcggccgctcccgtcagaccgagccgtgcggcaacggcgggcgcggtggccgggcaactgtggtccggcgtcgtcgtggcgacgacgacggcgtcgacgctggccgtcgcggcgcagacgagcgcccggcggccggcttcgacagccaggtcggacgtcgcctgtccggggtcgacggcatgccgtcggcggatcccggtccgtgtgcggatccatgcgtcgtcggtgtcgagccgtcgtgcgaggtgctcgttggtcaccacacggggcggcacccatccggccagcccgcacaggacggctgccggggcgtaagaaccggcggcggtaggggacatggggaatctccaggcatgacggaggacgggccgcaaggcccggacacggaacggagaggggaagggggtgtctaaggactcgtggtcctgcgaagggcgagcagtgcgaacgcgccgcagccgatgccgcccgctatcacgaacacggcggtacggatgccgtcgaggagcccaggcccggaggcgttctgcccaaccccgccggcgaccccgaccagtaaggcgaggcccaccgcgccgcccacctgcagggtggtcgacgccagtcccgaggcgatgccctggtcaccgggggccaccccggcggacgcggcgatccacatccccgtccacgcggccccctggccgacactcagcagcacgatccccggcaggagcgcgggatacgagccgtcggcggtgagcgccaggccgagtgccgcggctccggcggcacccagcgccatgcctcccaccagcatccggcgcaccccgaaagcggacacggcccgtccaccggcctgcgtaccgacggccaccaccacagcgggcacgaggaacgcgaacccggtggcgaccgcccggtatccgtggacggtctggaagtagagggtcaggaagtacggcactgagctgaatgtggcgctgaacagggcggtcacccccatcgccgcgagcaggccgcggtcggcgaacagccttgccggtacgagcggatcacgggatcgcctctctacgacggcgaagagcgccagcagcccgagggacagcaccgcgctcgcgagggccgcgggtgtgtcccagccctccgcgggggcctgcaccagcaggaacaccaggagtgtgatcccgcccgtcgcggtcagcgcgcctgccacgtcgaagtgccgtgagcggtcccacgggccgtccgcggggaacagccgccatccggccaccgcgagggttcccgccacgggcacattgacgaagaacaccgacggccagccgaacgcctccaccaggactccaccgaggagagatccgaagcagagcccgccggctcccgcggcaccccacaccgccaaggcccggttccggtcgggcccttcgtcgtacagggtgttgatcagagacagcgtcgccgggaacaggagggagccgccgatgccctggaccgcccggacagcgaccaagacgccgggcgtctgagccaggccgcccacgagggacgaccccgcgtacagcgacgccgcgacaaggaacatccggcgccggccgagcaggtccgcggcccggccgcccaacagcaggaagccgccggtggccacgacgtaggcgctcaccacccactgcaggtcgtggtcggagaatcccagccctgcaccgatgtcgggcagagcgacgtacacgatgttgtagtcgagcgagatgacgagctgacccgacgccagaacaagcagaggaagtccgatggactttcggagcggagccttcgccggctctgtcacggacatcatcgatcacccccctcgggatcacaacatttggaatttccacagaggggaattccggcagctcgatcgttttcagtcacgttagcagtccggatcggcattgtgaatggcaacttctcgacaggcattgcacattcacggaacatcagagcagcactgacacccggcagccggagactgccgggaaaggaacaccagcgacaccggatatggcctggatgtatttccaggctttatccgggatccttgctttcctgtattcctacctccgcgtcagtcctcccccatgagccgacggatctcggtgatgagggcgaccagcgcccggcgctccggaacagtggtctccggatgccagaggtcgatgagcaggcaggtacgcgggcgggtgcccgtgttgcgcgcctcgtgctcgaaggagtagtcgaagagcaggcacttgccctcttcccaggagcgagtctccccggcgaccgtgatgctgcaaccgtcagggatgtccacggcgagatgcaggttgatgctgaagttccacaggtcgcaatggggttcgatgacggcccccggcaacagagtagagaaatgacattccaggagagggcatatttttcccgtgtcgacggcgacgtctttcagcacctgatatgcgatgggaaccgttgcggccgactcttcggtgatacctccttcacggaagaggtagagggcctgccagttgtcctggcgggtcaggtagtgctcgtagtccgagaacgcctcccgtcgcgccgaccatgcgaccttcagctcttccttgatcgcctgatggctggcctccagttcatggacgacgggggccagttcggcgtaggcgtacgggtcgtgccagggagtgggagacagtcccggcatgatccacttggctgctttctgcagcggatgccgctcgctcccgctcggctccagcatctgctcgacccgcctgatcgattccgcaccgaactcggctctgatcgcggcgaaggcgttctctatctctggtgtcatgcggttctccggagttcggcggccggggtcactggccagcggtcgatgtccgcagcaccgttccccggcgctcgacctccacgatcgcctccgcgtgagcggcggcagcgccttccaactccccctccagcagcctcagggcgccgtcgatgcccgacgagacgaccccgccggccgtcaccaggtcaccgtcgtcgacgactcgctggtccacgacccgggctccccgttcggcgaggtgactcctggccaggtggcgcggggcggacggcagccgctccttgtcgaactccgcccagacgccggggctgtcccgtcggccgaagcctccaccgggtacgacgatcagagcggcgtcgcgcggggaccaggccgctgccgccaccctcgtgccgaagctgtaggtcatctcggccgcttctccgccggtcaccggtttcaccgtcaccggatgggcccgggcggccacggagaagacttcgaacgggccgaagacctgcaacttctccacgccgtccagctcctccacgccgtcgaaggtgacagtgcggatgcgtagcacctcgccgtcttcgccgcgggcacgcgccgggacggccgcgtgggcggtgccggcggcgagcggggccgccgagacggcgccgatcgccgtcgtggcggactgcaacagacgtctgcgttccacgtgtgccgaaccaccttcgcccgaagttccgcgctccgacctgccgacctgcctgcctcgcacggtggtcagcgggtggtgagctgcgctgtcgaactagtagtcggtcgcgcgtgggctcgagttcccgcgttctccgggccaattttccttgccttggcggcacttgaggacatgcggccgtcgggtcatactccgacgtgcctgctcccccgtcggccgcacgaacaagtagtcgcgccgacgggctgccgagttcccccgttcgcgcggtgttttggtcagctgcgactgcgaagacgcccgcggtcctccgccgcgccgtggactctgcggtgcgccggccgtggggccgagaccgccgaatccaccagcagacagagcaacccgctcagtatcagcccagcggcacagcccaccagggctccggggacaccctccacaacgaaaccgagccaggcgtagccggcagccagcacggccagggtggcgaagcccaggggccaggccccgccgattctcttccgtctgggttcggctcgggcggcctcctgtccccacggccaaccccgcggtgtatcgtccctcggctctcgcacgagacccagcacgtgatccccctcccccgccacggtccgcacttccgcaaccgcgttcgatccgggctccggaggggtctttccccgccaccacggggcggaaccggtcggctcggcaggggccgggaaccagcagggaccgcgccccgacctctgacgtatggagccgagaagcctgatgcgtgtgatgcgcccgacgcgcaacacatggttcgtcaacgccttacggaccgtcgcgccgccgttgggcgcctcctgcggtgcgctggccctcatggtcgcgtacaccgcgaccggcgcggcaggcgatccgccgcccaggatcacggtcgtcgacgcacacatcgtcgcggtgtccgcgggttccggctcgaccgccgcgtatttcgagatccgcaacaccggcccgtcgaaggacacgctgctgtacgcggactcaccggacctgggcgtcagcctcctgcgacgtacagtgcgccgcaccgggacggggcgtacggagcccgtgtgggccgtcgacgttccggcgggcggcacggtgcgcatggcgccgggaggtctcggggtcgtgatcctggatccccccgtactgaaagccggtcagaaggtgccctaccttctgtggttccgtcagagcgggaaggtcgccgtccgggcgaccgtgaccgcgggcgtgagatgagcctcggcggtcagggccggccggatgccggggagggtgccggtgcccccgctggcggtgggcaccggcacccgtttcgtcacgcggcgacggcggcgggggcccgcgactcctcggcctcgacaagaagtgcgacgagggtcgcccgggctcgtgccacccgcgagcggatcgtgccgacgggacaaccgctggcctcggcagcctcctcgtagggcagtcccgtcagctgggtgaggacgaacgcctcacggcgctcagcaggcagcgcgtccagcagatcgagcaaggccacaccgtcctcgaagccgggcagaccgctcggctgggcccgctcggcccataccgtccagtcgtccgtgtcacgcagccgcggccgggccgcggtgtagcgcacgttgtcgatcaccgtgcggcgcgcgatggacagcagccacgtacgcgccgacgagcgcccctcgaaccggtgcaggctgccgagtgcccgcaggaacgtgtcctgcgccaggtcgtcggcgagctgacggtcggaggagaggtgcgtgatgtagcggacgacgtcggggtgcagggcacgcacgaagcggtcgacggcgtcggggtcgccggcgcgggcggcgagggcccaggcggtggccgcatcgtcgggccatgccatggcgccgggctgatccgccgccttgcgccccgcgtcgcgcttctcgcgcgacacggggaggacaggagtgatcacctgatgtccttctcgggttgtccgggatccggcacggcggcacgcgcgaccgcgcgctggtgcgccgggcgtgagcaccgctgcggaaacgtcccgggacgggaggtgggatggggccgtacgacgtgaacgacccgtgcccgaagccctggcaccgactacgcggcgcccagcgggtggcctcgggaaaccagctgtctcaggcgacagccatcccggccggaggccctcgagaaatgatcgtgtgcgcgagcgacagccgcggcacccgctccgaacgttcgcgcgtcggcaccagacgcggccgacacggcggggcgggcagagcgagcgacagccgcagcggagcggccagccatcccgcgacggcccgcaacacgcggaaagcggccctctcgccgtaggccagccacagcccactcagcacagcggccagggcatgggcggcgagcatgccgaacgacgacccgccgcccatgtcgtgtaccagatggccaagttgccctggctgctccgaacagcccatgggcgcggacctcatgtccatggcgtccatggacgtggcgctcatggacataccacgcatgccgtgcgccacaccgcccgcgccggtgtccgatgccgccgactgggccagcgagaaggccgagtggagcgctccctgcgcgacgaccgcggcgggcaccaccagcgcgagtccgcgctcacggcccgccagacaccagccgacgccggtcgtggcggcgaacccggcggtcatcgtccaccagggcacggtggagcccgacatcagtacgtgaccgagggcggcgagcagcacgcagactgccgcgaacaccgcggcccgtatcgcgcgcgcacaccacccagcagtcatgacggcctcatcttcgcatccgggctccgctcgtcacgggtgggtacgcacagcacccgggactgccactcatcccgaagagagtgatacaggacacagcgcctcaccggtactcgacgggccgtcaggtcgacctctacgagtgagggatcacgtgccgtcctggcccggacggaccaccacagccagggtcttcacagcaccgctgcgtgcgaaacgcaacgtgaacgagacgagatcgccggcctgccagcccgcattcgccggcaccgtcacatcaaggccgtgcggggacatggcgaggctgccaccggccgggacggcgaccgacgccaccgtctgcgcggaggccgaccgagcgccggtcatgcgatggcgactgaaggtgccggcgccgtcgaccgcgcgggacgtcaccttcagcagccggtccgccgagccgccgctgttggtgatccggaagaaggccgccgtgtcctgggcgttgccgtagggcaggtacacccggcccccggtgaccgcgatacgggccgggctgcccgcgttgccatacgcggtccacgtgctcagaccgccgagggccaggccgcacacggcgacgggcgagagcgtggcgatcagggtgtcggtgagcctgcgccgggtgggccgccagacctgttgtccggtcatcgggtacgcctccgggcgggcgagggctgccagccgcgcaaccgcaggctgttgccgaccaccagcaccgagctggcggacatggccgccgccgcgagcatggggttgagcaggccgaccagggcgagcggcacggtcacgacgttgtagccgaaggcccagacgaggttggcacggatggtgcccagggtgcgccgggccagccggacggcgtccgcgagggcctcgatgtcgccgcgtacgagggtcacgtcggcggccccgatggccacgtcggtgccggtgcccatggcgatcccgaggtcggcgccggccagcgcggcggcgtcgttcacgccgtcgccgatcaccgcgactcggtagccctgctcctgcaactcccgtacgagttcggccttgccctcgggcgtgcagcgagcgtgcacctcgtcgatgcccagggtcgcggcaacggcccgggcgggcgcctcgcggtcaccggtggcgagcacgggccgcacgccgagccgccgcagccggtcgacggcccggtagcttccggggcgtacgacatccccgacctcgatcagcgcctcggccaccccgtccacacggaccagtacgggcgtgtgcgcggcggcctccgccaccggcagggcatccgcgagggctgcgggcaactcgtcgtccggggcgaggacttccaccagccgcccctcgacccggccgcgcactccccgccccggcattgcactgaactcgcccacgtccggcagccgctgctcgcgcagctcccgccgggcgtaggcggagacggcccggccgagggggtgttccgagccttgttcgacaccgcccgccagccgcagtaccgcgtcgcggccgagcccgtccggtacgacggtgacccgggcgacgctcatgtgcccggtggtgagcgtgcccgtcttgtcgagcacgacggcgtcgatgtgctgaagcccctccagcgcctgcgggccggtgacgaggacaccgagctgggcaccccggccggtcgcggccatcagcgcggtcggcgtcgcaaggcccagcgcgcacgggcaggccaccaccaggaccgccacacacgcggtgatcgccgcctgtggatcggccccggcgcccagccagaatccgagcgcggtgacggccagtgccagcacgaccggcacgaagacaccggccaccgagtcggccagccgctgggcacgcgccttgccggcctgcgcctcggtgaccagacgggtgatccgggcgagctgcgtgtcggcaccgacggccgtggcccgtacgagcagcagcccgccggcgttgacggccccgccgaccacggccgagcccggcccgacctcgaccggctcgctctccccggtgaccagggccagatccacggccgaactgccctccaccacctgtccgtcggtggcgacccgttcgccaggccgcacgacgaagacctgaccgccctccaactccgcaatgggaacgagccgttcggaatcaccgtcccgtaccgacacctccttggcggcgagttcggccagcgatcgtagcgccgccccggtgccccgccgggcccgcgcctccaggaaccgccccgccagtacgaacagcggtacgccgacggccgcttcgaggtagatgtgcgcgacgccgtccgatgcggagggaacgaggctgaacggcatccgcatcccgggatcaccggcacccccgaggaagagcgcgtacgccgaccacgcgaaggacgccaccacgcccagcgacaccagcgtgtccatggtcgccgccgagtgccgcagcccccgtaccgcccgcgcgtggaagggccaggcaccccataccgcgaccggcgcggccagcatgaaacacagccactgccagttgcggaactgcagcacgggcaccatcgacagcacgagcacgggcaccgcgagcaacgcggtgcccagcagccggtcgcgctcctgccgcgcctcctcggtctcccgcccgccctcacgcggctgcttcttgggcggctcggggagcgcggccgtatagccggccttctcgaccgtcgccacgagttgcccgacgctgacctccgtcggatggctcacgcgagcccgcccggtggccaggttcacggtcgccgtcactccgtcgagcttgccgagcttcttctcgacacgggtcacgcacgcggcgcaggtcatgccgccgacgctcagatcggtcgtcaccagggcggtcatcggttcggcgcccatcagccgtgtcccccctgcatgttgcccatgtcgtccatacctccgccgccgccgtcgcggttcgtgccgccgccgtgcataccgggtgcgacaggaccggcgccggcacccaccgcgtaggacaccgtgaagatcagggccagcagcagaaggaagccgcagagcgcgggcgggggcgccgccctccgcagggccgtacccgcgccggtcaaggaggattgccgggactcttccatcaaccgcgtctccaggtcacgtcggacggcgtcggtcggatcgcgccgtaccagttcagtagtcggaccagccacgggccgggttccggaggagctgtgtggcgcgcgtcacgcgaggaacgaccgtcccgtacgccacgtcggcggacggacggcccgccctgccgacgggtgtgcgtcgacagggcgaccggcctgcttggcccgggatccctcggagcgaccgggttcccggttcggccggcccgtgaagacgcatgtcaggagcgacgacgccccggaagcgtcgtcgtttccacggcgcgctgacgaatcgtcccggccagtacgggctgaccggcggcagcgatcacgacgccatggggaacctgcggctgatcgcccgcaccacgcccgttcccacggccgtccggcacgacctggcccagcagcgtcgtactgccgagccctatcacccctggcacggaccccgcttcagcggctgctggggcaccccgcggcgagctggagttccgccccgtccagcccgacccggtggcgtagtcctttccggccttgctcgaagccacagaatcagccgccgcacagatcacggccggcgagtcgcccttactcagggatgaccagaccgcgggcacgcagctgcggcaggcagatcttcaagcaggcttccaccgaggcggcatcagtacgcacgagcaggtcttcgtggaaggggagaccgttcgcgacgaaggtccacggtctcactccgtcacgcatgcgttccgcgtccgccttgaacagcaccgtgacgccctgctcggccagcgcctccatgacacgcaccacgtcgaccaacgtcccaccccgcccgttcgaacaggcgggccacgctacacggcacacatgcagctgacttgacggcatagcaacgtgaggtgtctcccggacttccggcaggctgttgcgccgggccgctccgcgtcatcccgcggcgttgaggatctcccggatgcgggttgcccaggtccggggatggctggtgtttccgttgtgtccgccgggcagctcctgcagttcgcggtcgaggagtgtggccagggctgtcgcggcccggtagtcgaagacggtccgcggggtggtgcgcccggcggcgggcacgatgtgtgtgctgacgcccttcagtgcggcgatgtcgagggtgtcgtggatgaccgcggtgaagtcgtggcggatgaagtagtcgaagttggcggtgcgcagggcgttcatcggctggggtgtcagatcgggttcggtgtccgtggcggcggggtcgatgcccagggtcctggcgatctccgggagcgcggcggccaggccctctcggaggtagaggtcctgaagggcgacgagttcgtgctcatggcgggcgcgttcgtcgtcgggcagcaggcgtggggcgacgggctcgtgggcgatgagggtgcggatctgttcggggtgccgcacgatcgcgtgcatgccgatgacggctccgaggctgcagccgagcatgagggcgggggtgtcggtgagagaggccagcaggcggtggacgtcgtcggcgtgctcggccagtgtcgcgcctcgctcgggggcgtcgagccggctgcgggacagcccgcggcggtcgtagctgaccacggtgtaggaatcggtgaggtgggcgacgaggtcggtggtgcggtcggcgtcgccctctccgctctgcgagatgagcagcagcgggccggtgccgcggatctggtagtgcaggacggcgccgggaacggcgagcgtgccggtggccttgggcatggcggtctcccttgtgggcggcggtccttccgccgcccttcggccaacttaatccatcgaactagatacatcaatctcgatgaatctagttcgatgtatgttgggtggtgtgaacggagtcgagctgttcctgctgggacgcgtcctgatgaagatcggcgaggaagccctgccggagcctccgggcggcgccggccgctatgccggcagcgcccggctggtgttgatcgtggctagcgatatcgccgctcatcccgacaccgctgtcggcgagatcgccgcccgcaccggtctgccgcagagccaggtgtccgcggccgtcgcccggctcaaggaagcccggtcggtgcagacggcgccggatcccgccgaccggcgccgtgtgctggtgcgtcaggctgccgaggtgtccgagcgagtggcgcaggtccgcgcggtcggcatcgaggatgctctcgccagggcactgggatctgatgccccgcaccggctgagggaggtctcggaagcgttggatgtgctcgcccggaacctcctgccgcagtcgggggccccggagtccccccaggcagacatcgttccgccgtcgcggtaaggccgctacttcgttacgttgtccttgttcgccttggtgcgggccaggcggtaagacgcggtgccggtctcgatgagggtggcgtcgaagatgagccggtccacgatcgatcgccacacagagccgcggatcggtgaacgtttttgtccagccgtctggcagggctccgttgttcggggtggctccgcggtactgcggagccttgggcaaacgcgccaactgccaggtcgccgcgggtttggatcacctctccggtggcctgcgtccacgggcgagggcgctctgcggctgaggcaatgttgtcgctgcggaaccggaagttcagggcgaagaactcttcgtcgatttccgcggtcgattcgccccttgaagatccttgaagacccttgaagatcaggacccactcctcgacgttgtgtcctccgctctcctgatacagcgccatggctgtcgccccgccgtcactcagccctccggaaccccaccccgactccaccgcctcacgcgcccgacatggccgaacacatcgcgggactctgcaccacccgccacaccccttacgcccctcgcgctctcttgcgccgcccactcggctgcccaaagcctgaaaaggatctgggagggaggcccatgaccgagaacgagaacgaacgtgccaccgaactcggcgacgccatcgaggcagtacgccaggggttgctgaaggcagccgcacaaggcagcgacgacctacgcttcctggtcaaggaaacagagctcgaattcatcgtcgaactgcggaagacggggtcgaccggcgcgggtgtgaaggcctgggtcctctccggtgacggacgcctcgagcggtctgccggccaaaccaaccggctcaccgtccggctggggatcctggccccggaatcacacccgatcgacgagacccacttcggcgacaagaaggacaagggccacccgggaccgcggcagatgtgaccagccgaagccggatcgagcaaacaactgcgcacggcccacggcatgctggagacgatggggatgaccgcgttcgccgagcgtgccggccgcgaactgcgggccgccggcggaaccgcccacaagcgcaccgccccggcccggcatgaggaactgaccgctcaggaaagccagatcgcgcggatggcccgcgacggcctgtcgaacccggagatcggcacccgcctgttcatcagcgcacgcaccgtccagtaccacttgcgcaaggtcttcaccaagctcggcatcacctcacgcagccagctcgaccgggtcctgccaagcggccctggcggcgcataagaggacgttcagcggcgggttttcaacgggacgggccggcggacaccgtatccgtggttccgctggaacccccagtcgtcctacaggagctacgagccgttcaccccgagatcttcgcgagggcgccgacgggggcgcgatcctcatgagcggggcggctctcgttcgatctgctcagtcctgcgcagggggatccggagcaagcaccacgtggcaggccgaccaggctggttggctcagcagggggcggaatcgagtgcacagggcgaggagttcggatccccacttctcacggaaggccggatcgatgcgggcgaggtcgagttcgttggcggcagacagctcagcgaagtcccggcgcagctgcggctccggaatacgggcacggccggtgaaccggtcgcggaaggaggcgtcggcatccgcgagcgtcggataggtggccttccggtcgcacgaggcgtagaggtacacgatgccttcggcctcgacgccgatcgccgctgcgagttcgtcgcggcggtccagggacagcaatgcggcggggaagccgtcggtgccgtagaacgcatggcacaggcccgcaagctggagggcggtgcgtgcctcccatacggcgagttgctcttggacgcgctggaggtgcgcgaggagagtgccgcccggatgggcgatctctgtggcgccgagttcgcgcaggagcgcgatggcctgagcggaagcggcaggggaagcaggcacggggcggagtccttacgtcgctcggggtcggcacccgtccgcgccttcgcctgtggtccggaccccgggaaagcacggacgggttgccgcctgggccctgcactgatcgtcctggaccacgtaaccccagtcaatcctatggatttctagcaatacccaagctgtagcttggggttatgactttggaggacctgcgcgtcttcgtggccgtgtgcaaagcgggaagcctcagcgccgccgcccgggacctggactgcacacagtcagcggtgagccagcatgtgaagcggttggagcgagagaccggcgtgagcctcgtggagcgccagccacgaggcgtcctgcccacacacgcggggcgcgtcttgtgcgatgccgcctcggacagcatcgccggtctggatctggccctgcgtcgtctcggggaccttgtcaacggggacagcggctccgtgcgcgtcaccacgggcggaacaaccgtgcggcacttcatgtccgaggccatcgtcgccttccgtcagcgctacccgaaggtcagtctggagttccagacagagacctccagccgcaactgcttcgacgccctcaccgccggcaacctggacctcgcctgggtcacgatcgccggcccggtgcgcggtatcgagcaacgccccgtcgtcgccctgccctgggtactcgctgtccgcgccgacgatccgctcgcgggccggccctgtgtcaacacagccgaactcaccgacatcagcctcatccggctcccccacaactccacctcaggtgcccgcctcgacgccgcgttcgccgagctcggggtccggagcagctccgacaccagcgtcgccgactgggacaccgccctcctgctggcagagctcggcctcggtcacgccgtcgtgcctgtcctgcccggctggcaggtacccggtgacggccccctacggctcgtccccatccccgacctgcccccgctcccggtcggctgggccgtccgccgttgggacgctctcaccccactggcccgggtcttcgccgacactgtcgcccgcagctgcaaggagaagaccgccaacactcggcccaagtagcaagcggcctgggcagcgctgatgagtaggttcgccccatgggccgtgtgcccagccctacctctgtccggcggctcatgcgcctctccctcttccaagagggagagcgaagcggaacaggttatttcccagagccgttcgtcctctccgcgtcgttgtctcccgatggctgggaggtgggcgcctggcggcctcgttgaaactcgatgtcggtggcgggcatgccggggctagcgttgcgccccatggatgacaaggatcttccgccgcgccttacccatctcacctttcacggtcccctttccgaagcccgagccgcacggatcatcggcagacttgcccgagcggcaccctcgactgtcctcgacatcggttgtggctggggggagctgatgctccgcaccctcgagacggtggagggggcgaccggtctcggtatcgacctcaatggccaggacatcgcccggggacgcgagaacgccaaggcccgtgcactggctgaccgcgtgaagttcgtcgaagaatctgcagccggaacggcacgtgggcctgctgacctcgtcctgtgcttgggagccagccacacgctcagcgacgcacagccacctcagcacaccaccgccgcactgcacgcgctgcgacggctggtccagcccgggggacgcgtcctcctcggtgagaatttctggcagcgcacccccacctcggccgaactcgacgcgatgtggccgggcgcccgcgccgaagagttccacgacctggccggactcgtcgacctcgctgtcgcctccgggttccgccctgcctggatcgagacggcgagcagcgacgaatgggacgagttcgagtccggctaccagtccgacgtggaggagtggctggccgcccacagcgaccacccgctggctgctgagacgcgggagcgcgtggaccggcaccgggcgagctggctgaaaggctaccgaggagtactcgggctggcctatctcacgttggtccccgttgaccactgagcttgagttcgtcatgtcgtgcgagatcagcccgatgcggttgtccccgatgagcggccacgtccgtcgccgacagtcgtcgatccgtcccgcgccaccgacagccgcggatcgtcgtgtaccggctgccgcgcgcggcggcggccggaggatcacggcgagtcgccacggctgtgaggaggcactccgcgtgcgccctcaaggatcgcgcccgccagcgaggaagggtcggtgtccatggtcaccgtgcgcggccccggcgtcctgccggtcgatcggactagcggacaccgtcggcaacacctggtccgagccatttccctgctcagcgatcctccagccactcccctcccctcctaccactcccctcctcccccctacacacccgacctgcggatttggtgagtccggggtcaggaggcagcgttcatcaagtcgacggcggactgctggcgggcggcgtcggacgtgtcgagggggccggcccagtggaggccgtaggcgtcgaggggcgtgcggtcgttggcgtatgcggagtcggcctggcggtggatgtaggaggtgtaggggcggtcggagagctgggcgttgaaggcgttgaggcctcggatgtaggcacccttgaaggagggtccgtcggcgccacagccgcctgtctcgcatggttcgcgcaggattccgccggagttcagtgcggtggaggtggtcgaggcgtcgccgatctggcggcccttggtgagcagggcggagttcccggtggcgcgatagagctccgcgaggccgccgaggaggacgccttggttgtacgaccaggctgtgtcgccgttgttggtgcaggtcgtgacgttgatgccgtcgttgaccagatgggagctgttgatcatggcggtgccctggaaccacgaccactccgcgttcgcacgggcgaggtaggtcgtgtcgctggggacgcggttgtggagcgcggcgttcagctccaggtagagggagttggcgatggcgttcttgtaggtcttggcggtgctccaccagacgccgccgccacatgtcgagtcccagtaccgatgcatgtggtccgcgtcggcgcgggcggtgttcaggtacctgctgtcaccggtcaggtcgtacgcggcgacccaggccagcccccaccacccggtgtcgtcgatgtagtcgttggtgaagttgccgccctgggcgtgcaggttgaggtcgtaggtcttggcgatggcgtacttgtagctgctcatgccagtgacctgaatgttgttgatgagggcggtcagcgcgttggccgagttccaccagccggtgctgtcgaacaggccggagctgaggttgtacgactgcatcagcgcggtggccgccgcggtcgggcggctgccggcgttccaggtcgtacgggcccaggccgtgcaggcgatctcggtgcgattaccggccttgccgcaggcgcggagggcgccgacgccgaggttgttccaatcgtcgacgttgtacatcagggtgcgccagccggtctggcccgaggggatcgtggtgtcgccgagcctgctgccggaggtccaggtgcggccgccgtcgaaggagcggtcgagccagacctcgtcggtggggctgccgttggtgatcgaggcccagcccatggcgtcggtgtcgtcgaagtgcagggcgatggtgcgggagtagatgctggtggtcaccggccggcggtcctgcggggacagcgacgggtcacggccgtcgcagtacttgttgcagacggtcgcctggactgctgtggtcgcggcttcggcgcttccggatgccgggatcaggagagccagggacatcacggtcgcgagcaggccggccccgagcatgcgtgttcttcttgcctttgagtgcatgtcagctccgtcgaggtcggtcagcccaggcgccactgctggttggcgccgccgttgcaggtccagagttcgagcgcggtgccgttgacgttgccggaggcctggtcgccgcccgtgacgtcgaggcagaggcctgactgggtgccggtgacggtgccgttggggttgaggctccacttctggttggctcccccgttgcaggtgtagagctgcaccttggtgccggaagtggtcccgttgtcgtaggcgtccaggcactgggtgccgccgtagagccggagttcaccggcggcggtgatggtcacggcctggttggcgccgccgcagtcccagatctcgatcttggtgccgggggcggtctggttgtcgtacgcgtccaggcagcggttggaggaggcgccgaccagcgggtgggtgctcccggcgctggtgccactgccgacggagacccggtacatcacggagccgtggccggggacactggccgagatgcttccgccggtgctgctgacgacgtgtgaccagaggttgtcgagccggtaggaggatgccgcggggagaccggccgcggtggcggaggtggtgatggtggcggcggaggagttctcgttgaagagcaccaccgacacgtcgccgttcgccagcggtttggtcagcacgtggaggccgccggaggaggacacctcggtgccctgcttgcccagggagtcctggtccacggcgatgacgtccttgttgccgtagaggaagagggtggcggcggaggccttgcgcaggtcggttccggcgatcaggggcgcggccatctccgaccagaggctgaagtgggaacggtcctcggtgaacgacatgccgttgccgacctcgagcatgtcggggtcgttccaggcgcccggcttggcgtacggagcgagcttgacgttggccttgtagatcgacaccaccgtcgagaagttgacgttgatgtcgtcggtggtgcgccagctgttcccgacccccgctccccaggtccacacactggccagaccccagttgcacaggctgtagacgatcgggcggccggtgttgaccagggcgtcgcgcatggcggtgtagcgctgctggtcgggcacgttctggtggttgcagttgtcgtacttgaggtagtccacgccccaggaggcgaagctgtcggcgtccgtctgctcgtggccgaggcttccggggtagccctgacaggtggcggtgccggcgctctcgtagatgccgagcttgaggcccttgctgtggacgtaggcggcggttccgctgatgccgtcggggaacttgaccgggtcgggcaccagttggcccacggagttgcgggccgaggtcatccagcagtcgtcgatgttgacgtactggtacccggcgcccttcagaccggaggagacgaggtagtcggcggtctgcttgaccaactgctcggtgacgttgcagccgaaggcgttccagtcgttccagcccatcgggggcgtcctggccagaccgttgtcgagggcctgcgcgggcggtgccgcgcggagcaccagcagggccggagcgaggaccagcagaagcagcatcgcgaaggcggcgctcaggggtctcaggaaggatggcgggacggtcatgtcggtgtctcctgtttcgccgtgtggggccggacgaactcaagtgcctgacaacgttgttcagttgccgggtgtggcgcctttggaaacgtaaccatcgcgaagttcccaccggccgggcccagccgtcaataatccgtaccaaactgtcgcgggggtgaactactcgcgctgtcagaagcgttgacgaccttgccgaccacatcggcagccgcggcggagcgcttgggcccggcccgggcgttgacgcgcgccgtcgccgcgtactccgcgctctggagacccttcggaacgaacgacggttccgggctggtccgcgagcaggttccggtggccgccgacgacaagccgtactcgtacgaatggccctactcgcaggtgcacatcgccgcgctcgacctcacggccgtggacgcggcgtacgagtcggagccagccgaacggacaaaggcgcaggagcacttctggcacgtcggcaaaggcacgaccgggtgtcccggatacgcctcctaccctgtcgtcgcgtgcggcgagggcggcgagggcggcgcagcgccacggcggcgaccagccccatgatcgagcgtcgtaatctcacttggtgtcccttcgtcgaggtcgggacccgcaccctccaaggcggcagtcagggctacaagggttcttcgttgtcccggacaggactttggcaattggtgcaggtcacggctgtgcccgcccctttgtcccggacagcccggacagtcgtgaacatcggcggctgacttggcgatcctcgccctggaaggcatccgatcgtcggtactggtgacagaaaggcggacgaatgagtctttgtcacaagccgcgtgcctcactggtgacaaccaggctgcttcggcgggtgccattcgccagctcatccggctctgccggtgacaactactgagcttcggctcactacgacgacaacgaatgggtcggcctggcgaaggaccagcgacacctgcagaccggggacgccgccgccctggcccgcgcgaaggagatcttcgccctggtcagatccggctgggacaccgacacgagctacgccgcgcccggcggcgtcttctggacccaggtcggctggagccaggaccgcaacaccgtctcgaacatgccgggcgcccaaagcaggcagcgttcgcgcagatctgcgccgtgctcgcctgaccccgcgccaagtggcggacgctctactgactactgggtcccgatctcgcccgtgccgcgcgcgatcaactggaccggcaggaccgtgcggcgggagggagcgtcgtcgccgtcgatgcggtccagcagaaggcgggcggcatggcggccgagctcctcggtgtcggaggtgaccacggtgaccggggtggggagcatgtcggccagtttgaagtcgtcgaagccgacgatcgcgacggaggtctggagctgccggcaggcgcgcaggacaccctcggtgaggaagcccgtcgtggagaaaaccgcggtggggggatccgcggaggtgagcagggtgtgggtggcggccgaggcctcctcggtggtgccacggcgcagggtgacaaccaagttgctgtcgggagtgatgccgctgcggcgcagcgccttgcggtaaccgcgcagccgtcggccggtgctgtagtaggagggggcgccgaggatcgcgatccggcggtggccctggtcgatgaggtgctgggtggccttgcgtccgccgtcctcgttgtcgacgaggacgacatcggcctcggcgccggtggccggccggtcgacgaagacgataggcacgtggtcatggccgttgatctcgttgaggaaggcgtggtcgccctggtcggggacgatgatgagcccggcgacgcgccgtccgatgagctcgcccaccgcgcggcgttcgacctccgggtcctcgtcggccgtactgaggaggaccgcgtagccggcccggttggccacttcgacggcggccttggccagggacgcgtagaacgggttggtcagatcgccgagcagcagcccgatggtcatggagttctgcccgggacgcagtgagcgagcgagctcgtttcgctggtacccgatggcgttgatcgccgccatcacacgctcggccgtctcctcacggaccgttccgacgccgttgacaacgcgggagacggtgacgagggcgactccggcccgctccgcgacatcgcgcatcgtgggcctggtgttctggcggtgcgggggacgactgctcacgtgagttgaagaccaaccttccatcgcgtaccgggggccgggaccgccctcaggatacgtttcgggccccggcccgctgcccggcccgggtggccaactgttgctcctgattccctagttgctcttgtcggtcatggtctggaggtcggagagcggctttgtgccgtcgaggatatccggccagtaggcggtgatcaggtcgttcgactggctggcccactgggtggtgaagcgcacgccgatgctggacgacgtgttcagtcccgtcttgacggtggacgcgacggtcgtcaggccggccctgtcgagggcaccgaagtaggcgtcctgcgccgggaggtaggccggggccgcagcggggagtcgggcagcaccttggtccacacggtggagtcgaggtatttgaggaccttgctccgcggagtccgacaacgatgtcgtgcggtcggtgaccttgaaggacctgcgcgacgggacgcatcgcaccctcgccgcgcgttacgtcctggacgccaccgagacgggcgaactcctccacctcgcgggcgtcgagcacgcgaacggggccgagtcgcgcgccacggcgtgcccgctcgccgacctggcactcggccgcatcgtcttcccgaccgcaccgttgccgcccggtatgacggacccgagggccgcggtcgacggcgacgccggcaccgcatggtcccccggtcctgacggtcgcatggtcgtcgacctggacgccgaacagcacatcaccgagatccggacccagtggcgaggaggccatgccccggcatcccaagtcgagttcagccgggacggccgtacgtacggtggcgctgcgcagctgtcggcgcgtggcgtcctgcgcaccgacagcaccccccgcgacgtggcactacgggtcatcacttcgtccgcgggacccacctcactcatcgccctcactattgcgtaggagtggccgcatcggagactcccgtctcgggatgaaccgacgcacggggtgcgacgcacggggtgcaacctggcgtgccgccgcccggctggaggacaattgctgttccgacgtcgcctgccagtgatctttcgctggtacggtccggtcgtgccgcgcctggtggaagttccaggggacgtacgcttttggaccacctcggctgtgtctgctttcggttctcaggtcacggggctggcgttgcagatcctcaccgccgtggcgctgagcgcatccatcggccggctgcccctggtcctggggcccgcactgccgacgaactcgatccctcggcagctgacctgacacgccacggcgcagaagccgcggccgcagccggggagggcagggactgatcagctcgcagtggcattgttcccgggccgtcggttcggcacgaggagccagtcgcgtatgaacgcaggtgaacggccctacactcggcccgacacaggaccaacagacttggagagcgtattggcagcgcctgacttggatcaacagcctcgcgacgtaggcggcacgtgatcagcttgtggtgtggaagccatcatcgccagcgccgtagccgttctgggcaccctgctcggctcagggatcacccttgcatttcagcgcagcacagccgagagaagccacgagttcacccgccgcgagaagctccgacaggaacgcctcgatgcctactcggcctacgccggcgccctggtcaactaccggcgctgtctggtccacctgtggttctgcatccatgagcagccgccccccggggacgcagacgaagttcgaatacgcgcctacgacctccgatcaaacacccaagaggccctgttccgcgtgcagatgctcacggatgacgaggctctgagccagtccgcagaagctgtactcactgacgtgacgggcctctacaagacggacagtcgaagcgagctcgacgagcgcagagcgcaaacccgagatgacatcagccacttggtacgcgcggccaagcaacatctctgacccacccggccggcgtggcgttcacccaggtcagccctcggagcccgcccttgagccccaagcttcccaagctaggggctgcttgccatggccagagagactatgaaactggcagtcctctgggccggaacgagatacccgaaagtgaaggcatgagcagggtcaggagcgaaccactcgaccgaccgtgtcaaccactgctcccgcggaagcacgcactcgcgctgcgcgggtggccaggtcttcttcatcagcggcatagtgcagtgtgaaagtggcgtcagccaattctgcgagccgctcgcgtatctcagcattgtccgtgagcagttgcacctcggccaaagctgcgatcactcccgagcgagcctccagggcggcggcctccgctgcatccttctcgggaacatcagcgtcgcgtctcccccaccggttgtactggagacggcggaatgaggtctcgcaggcgagtaaacgagcagtcgcttggcgcagttcgcgccgtgtctcagcatttagcgcaccggcatggagtcgttcggctgcacgggtttggaggacatgcgagaccacgacgccaagcagagttccaatgaccgcaacgacacccgtcaaggactccacctcgcggcctcccccatagtcaactggtatctgcctgcccagcacgacgcctgtccaaagatctgccacccgcctgaacggtctcgtcgttgtgccatggccctaccgccgaagccgatcccgaccgatcagcgtagagctgcggaccggatggtgggatcggtgttcgactacaggtcatcagaacagcttgggaacgatgcggctcgtgccatgtccgtgccagaaggttcggcccatggtgactgccactgtccgtgagtggcccgacgagaaagggtggggcgtgctcgactcccccaagactcccggcggctgcatcggccacactccgacatacagatgactgagttccgcaccctggcgccctgacagcgagtgaacctcgtgtgggaagcctccggcttcaaacaggacgggcacggctgccccgcggtgagcatcgtgcctagacctgcctgacatccacacctgactgtgaggatgtaaatggcgccgtccgaggggcctgaccctccatctgaccgacgcttgctgtcctgttgatgatttgtcggccgcttcgggcggtgccgccctgcacgcggccggtcgggcgtttgtgacctcataggagcccggccaaaggtcccatcacagtcttgtcctcccgcccgaccggcgcgtgccatcccctcatgcgccgcacggaaggacagcatcctcagcatggcagacgagacagcggtgatcggcggcgtcgacacccacaccgacttcaaccaggccgccgtgatcgatcccatcggcaggcaccttgccacccaggcctttcccaccacccccgacggctatcaccggctgctgggctggctctgctcccacggagaggtgatcgccgtcggcgtcgagggaaccggggcctacggcagcgaactcgcccggtacctgcaggacagccagatcaccgtcatcgaggtggaccgccccgaccgccgggcccgcagggcaggcggcaagtccgaccccattgacgcctacgccgccgcaaccgccgtcctcaccggccgagccggcgggatccccaaagcccgcgacggcatcgtggaggccatacgcaccctgcgcgtggtccgtcgctcagccgtcaaggcccgcacccagatcatcaaccagatccgcagcctcatcatcaccgcgcccggcgaggtccgcgaacagttgcgcaccctgccccctgcccagctgatcaagcatctggcccgctcccgccccggcacgcagaccagcgaacccgcctgcgcggccaagatcgccctgcggcgcctcgcccgccgtcaccaatacctgaccgcggagatcaacgatgccgatgccgagctgcagacactgatgaccgaagcagcacctgagctggtcgcattacccggcgtggggatcgagaccgccgcccagcttctgatcaccgcaagcgacaaccccgaacggctcgcctcggaagcgtccttcgcccacctgtgcgcagcggcaccagtcccggccagttcgggccgcaccaacaggcaccgcctcaatcgcggtggcgaccgccgggccaaccacgcactccacatgatcgcgctggtccgcatgcgctacgaccaacgcacccaggcatacgtcgcccgccgcaccgccgaaggcatgtccaagaaggacatcctgcgctgcctcaaacgcttcatcgcccgtgaggtctacaagtacctcacctaccaacacaccccatcgaagccgctcatcccaaccgcttgacgcctataggagcttcatcaacgacagcgcacgaccacggtccccagcgattcactgtgccaccgcaccccctgccccgcgccacacggcccctgccgggtcggctcgggctcttgatcacgctcgatcccagaccgggcggccaccggccaaacccactccaccgacctcacggcactccttcatcagtcgacggccttcaagtggcccagggcatctccgaggtcgagttcggtggcaccacgggtctggaagccctgcttgaacagctcagccgtgcgctgctgtactttctcgcctcggacgagttgttggaacagcgcggcgtccgcgcgtacttcggcaggagccggcaggctgatggcgttgatcgccgacttggctgcgatcagcgcatcgcgggggaaaccgctcatgcgcgcggcgatgcctgctacgaactcgtccagttcggcgtcagggaccgcacgattgacccatccatagcgttcggcgaggtcggcgtcgaagtccgacgacgtcagcacggcttcgagtgcacggccccggcccagcagacgggtgaggtgctggatcgcgcccgcgccggggggtgctccgattcccacttccggctggcccaggatggcgttctcccgggaagcgaagcgcatgtcgcaggcaaggagaaactcactgcccgctccccgggcacggccgcgcagctttgcgatggtgacagccgggagctggctcagcttgcggaacagcattcccagggaggcatcgccggggcctcccgccttcgcggcctcagcggtgtactcggggactttcgtcatgtcgacgtgcgggaagaagaagtcggcgtccgcactgtcgaagatcaccacgcgtggggcggtcgggtgggccagttcctcgagcagtgcgaccaggtcccgcacgacctcgggaccgatgaggttcatcggcggcgcgttgaacgtggcagacaggacggtgccatccagcctggccttgatggtttcgtacgaggcggtcatcttcggtcctcctgtcatcgctcagccccgtcctcctcgtggacgcggcgcagggtgatgtcgtgggattcggcgaccgcgacgacctggaacggagaccgtgaccaggccgaagctcatcgcctcgcgccagatcgctcgggacttgaagcgagcctttcgcccgggtttgccatgctatggcgaccctcgtcagtgggctccccggatggttccggaccgagctggaatcgaacatctgcccgatgcgtgtccgacaggtcgctatgggttcgccgcggcaccgttgcaccgtcgtcacaggtcagaccggaatccgagtgcagaagcgcagtgatcccaagctcggagcgcgcgttcgattgccgtcactcgctccaaggacgaaggcccaggcccgattcgcggccagcttgcgggccccgatctcctgatgaccgtaactgtgcggtggtttcagtcttggacgacgaagcggcaggccagagggctgattcgcggggccctagcgcagtacaacctcgcccgcgtggacggcgcgcatggcgcgctcgacagtctcctggttttcgcccaccggagccacgtagccgatgacgtcgcgcgcggcatcctccccgagcattcgggtgatcacccacgtggcgagatactgggacgccaggcaaccgcccgccgtagcgatgttcccctcggcgtggaacggcgcgtccagcacggtgacgtcgcgggcctccacaaagggtcggctcttcatgtccgtgcaagccggcatgccatccagcaacccgagccgggcgagcaccagcgcgccggagcactgcgcaccgatcagctgtcgcgaagggtcgagcggcagcctggagatcagccggtcgtcggcgaccacctctcgcgccttcaccccgctgccgatcagtacgacgtcggcttcggtcacgaactccatcgggcgctgcccggtcacgtcgacgccgttcatggacgtgaccaccggcgtcggtgtcgtgatgaaggcctccaagccgtcctttcgacaccggttgatcagcgcggaggcgatgaagctgtcgagctcgttgaatccatcaaaggtgaccacggctacctgcatggcatctcctcaaagcacggcaatggcgtgcagtctctcagagcgctgtgcccaggtcgcaggccaattgtcagtcggtggctcatctgtcggtgccgcagtcgccgagtcgcccctggaccggttgatggccgagatggaggcatcgaggctggacctggaccgtgtcgccggttcggtaaggccgaagggcgaagccgggctcgtttgaaaggtgagtgcggtacagcagcgaagtacagcgacccagctgatcctggggaccaccacgagccgctggcgcccctttgaccaggctgggagacctaggagaccgcgctgcccgcggctcgcatcgagggggccaggtcgggccagaaccttctcgtcccccagggcgtctggagagctcgcaccgctggacctcggtcagcagcgggcgggccccggccgcgcccgtcgaggccagcgccgccgtcccgccggccgcaagggcgcggcgccaccggtcggccgccatcttcgccacccggaaacgccgtgccacctgctcgtcgctctcaccagcggcgatgaactccgccgcggccatgcgcacctgctcgcgccggtccctgaccgcggcatcgagcccaccaccctgtgcgtacctcacacatacgacgcaccgcacaccgcacaccgcagcacgtcacagcagagcgcgaccctggcgcaacacccaaggggaactctccagcagttccaggagggggtcactgccaagtcccgccaacccgcgtggccacccaagcaatgcccagggtcagaggcgaacggtcatttctacggtgacctcgtcccctgtcgaaagaccctgtggtttgcgcacggcctgtttgatcgggagcaggtactcgccgtccttcgggaagagtgacgtcgcaaaggcgatctcaccgatccgggcctcaacaggaacaacgccccacccgtacgtggccatcgacgctacctcccgtatgtcggcagactgctcctccggtacagggacgaagtagaacggggaaggcccgcgccattcgatcacatggctggagaagacgacgtccatagggccggtccgttccacgaggagtgctgaatcccactgagcgtacaagcggtgccacctcgtggacgcagatccagtcccgccgcgaaagaggccggaccgcaggggccagctcaagaacacatgaccaccagggccgaaggtcgccgtcacgaccagatggttgttgactcagacccgctcaccctcccaaccgcggaagtcgcgcgcgaggccatcgaagaacccgcccatgtcatcccagacggtggcggtcaccgtgtcgaaccgtgcacgcacaccgtcagcaacggcctccacagcgaaggcgacctcgtactcatccgcacgcgaccagtcgaacaacctgacagtggacgccaaggcccacgcccttgaacgacgagctcgatctgtcctccactcacctcgatcagagtcacccgtcgaaggatgcggacgccaaccagccgacgtcatcaccgttccgaggcgcccgaacgttgctacttctcctcaacgcacttgcctcacacgtatccgaggggtcgtcaggcagtgcagcgaccgcccattcagctccctgtagctgcctgcatttgcctcacatgtatctggagggccgtaatgtccgagcccgctgatagtgtgccgcgttcggccgaaaagatcacgagaggacggcagccgtgcaggaagtgacgcgccatgaggtcagcggacagcacatagcccacgcgctcgacgacatcagccggcggacccggcggcggtggcatgggatgcgctatgacgacccgtccctggagaagttgcaggagatgcgtgatgagctcctcgaccacatcgccgcccgtaccgtggaggaccccgcgctcgacgagtcatctcgagcggcactgcggaccgcggcggagtgctccctgggggttctgagcgttggctgcttccccgacggcgaccaggagatcgtcttcccgctcatcggcgagaggctcggcagcgaggacatcgccttcggtgacgtcgtagagcaggcccccacggccggaacgtgggttgacacgtttgcaatatgtctggtcagtggcctggtgtgggactggcagcgggtgatcggtctgctgctgcgggaggactacgcgcccgcgatccgcgacggggtgccgtactcgaagctgaactcggcgtcggatccggcggacctggctgcgatggacgcactgtgcggctacctgacccaggcgcaggggcacctgccccgcgactggcccaccgtgcccctgtgcaagccggacaccgacgagcgcgcagaggcggcccggaaactggacgcagccggccccctgacatcggaccagcgcctccttcgtgtactcctcgaagatgaccagcacgcctttgagcagactctcgtggcccatctcagcgagcaccgggagagcgtgggatccgatcccgcccccaggactctgctgccggtcggcgcccttgctctgaccgctctggcggtccaagtgcacggctgggagctggacgttcggtccggctatctgccgcacggcatgcttggttccccggacaccctgcgccgagcggcggacgccggcgggaacgacctgggccactggaccgccaagtagcccgttcgaccgctacgtcggcaggccagcgaacagacgtgcgggttccgtttccgcctcacccccaggtgaggacccccttgcccggccctgccgtccgctacggatggcagggcccgccgcacctcccggctccccacgggaggcatgcggctgcccggacccggctgcggagagcgtccgccagccgccgccgggacccgtgaccggcgcgatggccgcgacctcccgcccgcacggctcaccgtccctgcaccgtgagactacggccggtggtgggcctcccaggcgcagcactgcgctccgaactactcctggccttcagccagaaggtcttggggccgccgcaggtgcagcccagaatgtgcacgccctcctgtttgtagctgtccacgtcatggggtgcggtctccgaaaaatccgtgcagcagcaccagcggcagtccactgcccacggtctcgaaggcgacctgtactccgtcgccgccggtgacctgcatgcccactcatccccggacgcaacaggagttgcccggtggaagtacatgcgccggcccgtctccgtcagccgccccaaggaggttcggaagaggcactcggtgatcagcgccgccaggacgggcggagctgtggtgaggggcggacgggcccgtgcaggtgctggtcgtggtagtcgtgctcgtacggtcctgtgaagggcggggtttcctccaggagctcgtacgccacaactcccggggcgtagatgtcgctggcgctggcggcccgctggttattccagcgttcgggggccatgtacgcgagggtgcccgcgagtttgagggtgtgcttcgcgatggtggcttcggcgtagcgggcgatcccgaagtcggcgaggcaccggcggccaccgagcagcaggatgttctccggcttgaggtcgcggtggacgatctcgcggtccttgaggtcggcgagtgcttcggcgacgtcggacaggacggcgaccgcctcgttgaggggcagccggccgtgctcctggaggtggtagcgcagggacttctcggcacggacatcaccagcgcccactggtcgtgctcgccgctgtcgatgaccgaccggcacgacgttgcggacgccgtccaggttggtgaacagcaactcgcgcctggcgcccggcgccagtgggccctagcttcacctccgccttctcgccgacggtgttctccgcttcgaacacggcgccgcagccgccgcccccgatgccggcgccgacggcccagtcctcattcagtgccagtctcatggggcgcgctgtctccatcgtcaactgctgtcccgtgcgggcggtttcgcaccgcttgcatcctccgtgggaccctgacagtgaggtattcgtggtgtcccgcgcaccccgagccgggcccccggtgtctgcttctggacagcacaggacctgccggtgccgagcaccggatcagcgctctgcgcgggcgggtgcccgggctgctggcgccgcccgccttctgtacgacgtccccgtcctcgcgtcaccgctggctgacctgctccaccatggcccctccgtacccatatggcgccccgtccacgacccgaccagcgagtccgctgaatcgggcccgagcgtcggcagacatgacgcgcggccgccgcagacgacggcatgaggctgcgcttcgcttcgcgcgcagatcctccgcagcgaagtagtcggccggccacgaacccagcgcgcgcttaccccttgtcgccctggacgaccgcacctccgaacaccaacggccggcctggccgaggcgccatgagggggcaccccgctacggaccacgaaggacaccacgagaggcgccccgaaaggcaacccctcgggggcgcggcctctgcgtacgtcggcactgcgcagaccggccgtggtcgggggtgggcgcggcactgcgggaggcatggtcggcctccgcgacggcgggccagctcgctgtcgtcgggcagcggtgatgagcgggtcggtgcgcaggctgtgcgcgaggaccaggcttcgcgcacaccgagcccggacagtgcccggacaagacgctgaccaggccggacaaacaacgaccgtccgggacagtcacaaactgttgctccagctcggccaaggtcggcaacctcgataccgcaaggcatccggcagaaaccaaggtgaaggtgtccggcctcaggcgacgcacgtcggtgagccgtgaagcggtggcaatggcagacgtgggctcgggcctggatggcgtcgccaggcgaaccaacggggccggtgggtcgcatcacgcatgggccggacggccagcgtcgtggacagtcgctggagcagtgtggatgccgttccacgctcgtatgcaagagcggcaaggcaagacaggcgcggagtgctgggcccttcgggcacggtcttcgctgaatgaaggggcactgatgcgcacacgcaagatcatcgcaggactcgttctcggcaccactgtcggactggggctcatggcgccacctgcccaggcagcttccacggcgtcacccgccgcttcctccgacactcggggcgtcgtggacatccaaggtgcgcaggcgagctggcacttctacagcagtcacaagacctgggtggaatgcggactccgagcgtcctactggcacgatctgcaccccacttgggaggcgaagtgccctgaattcaaaggtactgacggggtgaagaagttccacctgtacttgtactactagcaacttggtcatggcgaagccctccggtgtggtggaggtgctgagccttcaccgcaccgagatcttcgtggaccactgcaatgcccggctgatcgttcacggcgggcggctgctgttcgaagcgtgcccccggcgccgggggcacgactctcaaggggagggaacccacatgcgtatccgacgcgcactcgccaccactgcggcgactgccgcgctcgccggcggcctcgccgccgcacccgccagcgccgacaacagcggtgagatcaatgccgcggcagtctgcgacctggtgcccaactataaccagtgggactcggtcgtcgttcgccacgcgaccgcccccttccgcgacggaccctacgccgagtgcgatgggaccaccaggagcgcctcgtcctacctcgacgcatactgccgatacaagaacagccacggcaacgtctggtacttcacctactacggctgggtgtacggcacgcacgtcacccgccccaacggtgaacccgtctggtgcgacatgtcctgagctgcggccggcgctgctcgaccgactcggccagtcaggaccgaacacgccctgccacggggagctccgtggcagggcgttctgctgcgcgtcagtgcctgaacggaaaatctccccgcgccggggcgggctgcgcccatcattggccaggggttgggcgagttgctggtcaggagcggtaggttgattgcgcctcagcccgacctgacggcacgagcggtgcttcgcagggcgtccgggcgggtgatttcccctcccgtacgcgctccgccggagcggccgggggcgggccgcctgcggcgcggggccagccggccgcccggatacggcgatgacccgtggtgggtgcgccagcagcaccagccccgcgaccatggccgaccagctgcgggtgctcgttcgagcacatggtggacgcgttcggctatgggcccgaggtcttcgaggagttccgggtcgccgcggtcgagtccgcgttcctgccgctgccgaagcgccgtcgcctgattgaccaggtgatccgcctggggtacggggcgcttcgggccgacgggcgcggacgggccgcgcggcggaccacgcgcggtcgcgtcggggccggcagccggcggctgaaccccgcggttcagccgccggtctgcgtatagatgtcgttcaccgtcttgcgcatcaggtcggcgtgctgcttggcaacggccgtacgcagcccgaggaggtagtccttgccgccgatgcggaaagcccggaccatctcgacgcagtggaggtcgttctggtcgggccattccttggacggcttccggctgcacgagaagtcggcgattttcgtcgacgcatcggcccacttccagggcgccccggccgcatgcttgttcttcgggtcccgcacatagccgtcgatcgtcctgcggctgcagggcccacccgtgcactcccgcaggtcaaagacgatgatgccgtacacgggacggggatgtccgaggatgccgatcccgcatatccattgcatggcgcagctcatccgtggtccccggaacacaaaggggagagattggatgccgttgagctgggaccggtcacccggtcgccagacgggaccgtcgatggatcgtgcgacacccctgcggtagcgggtgtacggcgcgtcgccgggcagcgggggacgggggacggccacgagggcggtgccgggggattctcccagaccggcgttggccagaacctgcctgaccaagatggccgccacggccttgacgcgctggccgtccctcgccacctcggtgtacgtgagatcgacaaacacattcccggttcgggcgcccaccctcgccgaccacccggcgctccccggctcgttctctcgcgggctgatcacggcccggtcgcccactccggccagttcaagggtgctgacgacgttcagctgccggtcggccaccatcacggcgctcaccccattgccgggacgcgcgacggtgacggacagtgtcacttcaccgtcgcggttgaacggcgcctgttcggtccagtggcaacggccggagccgtccgcccgcgcccaaggatcggtgatcgccggttccagctgttctcccctcaggagtgagcacgccggagccacggaggagtacggcccggaagggccaattgcgttctcagccgctgcgagcagccacgcgaccagtcctacccaaataaccatatgcacgacaaaagcaagccgtcttatacgaagcgagtgcttcttccgctgtgaaaagtccttcccggcaagtctgttgagtagttccagatgccggaagcggtaccgtccgccgctctgccgcagtacgccacgcccgtgtgcatcctggagaaaggccccgagtcgccaaggcagccggcccgtcgccgcaagccagatccgggccacgttgaaccgtccccaggccgaccctccgacttcgtacagcagccaggcgaaggtattcagcaggagcgtcacgcgcccaacattctgctcaggctccaggatgtcgatgttggactgccagagccacgtgatcggcaggatgaggaacagagccaaggagaagaggtccaaggggccgcccctttccttgaagggaagtacccagaaggcgcccttgacccatgccgcggtcctgtcccgtcgcagcagttcccaggggctgctcacggactccgtgtccgacggttcactgcgcaggaacggcagggcccgggagccgcgcacatgcttggggcccgggaaggccgacgggtcggtggcgaaccacaccgtggtcagcagggcgagaaacagcagcgcctcggtgagccagatcggacctcccggccaaaaggtcgcatgagcctcccctaggccggaccagtaggtgacgcccgtgatggccgcgatcaacggcacgaaagccaaccagccgacccaccggggtgtcgtcgtgtccagccgccaccactccagctcctgcgtccccccggccctcacatggcgggcgaggaaacgcagccagatccctgcctgctccgcctcccaggtgcggtcggccagcgcgccgccgtaaacggaggggatgaaccggtcgaagagatgggcctcgatggccgaactgtccgggaactgccgcgggtcgagcagctccatcggatcggcccgtgtgtcgctgtacgccgcacgggccaggccgaccatgagcggggtcgacagtgctcggcgcacgtgcctcgcctgcccgtcctcctcgcccagccgcgcgagcaccgggtcccacgttgtcaaggtcccctcccccgacttgaccttgcggctggtgcggggcagatactcggcgagctgatccacggtgagccgttccagctcgaccacggccgttgccgtgaggacatcgctctgtgccacggcctgctcaaaggccgtgctccggctggtgagcacgaagcatgcgtcgcggccgagactcgcattgaactcggccagtgccgtggcctgtgtgaccgtcgggatctcgtcgaagccgtcgagcacgggcaggatccgcccggtctccaggagcgcctgtgcgatcgcccgtcgctgggcgccgcgggcggcaaggctcggatggcggtcggagacgagcgccgcggcccactgccacaacccctgctgccgcgggtcccaggaggcgagcgggaagatcacgggcacgggactacccttgagcgcctgccgagcgaagcgcagtgccagcgcggacttgcccccgcccggcgggccgagaacgacgagccgacgcgagggaatacgcttgtacacctcgttgatctcggcgaactccccctcgatgtcgggtatctggccactgtcccggctgatgttctcccagtggtcgacgagttcgggatcgccctcgctccagcggacccgcagcgggatgggatcgtgcacccgggaaagccgttcctcccggtcgtacatcgtgcgcagcctcccggccagctgcgttgcggcgatgtctagttgacgctcggagaacacgccacgccggccccggcgtgcccgcacgtgggcgacgccgagatacgcggccacgaccagcagacaggcagcgaccgtccaagcggggccggggcggcgtcggccgaggtccgacacgatcagcgcgacagcggcgagggccaggaacagcaccgccacgggccgcagcagcccatggatctgggggctctccgggcgatggacatggaagtgcacgccgccgtggatcgcgccggcctggatgaggttctcgacgtaaccgccgtccatgcggttgacgaccgtatgagggacacgcccgaaacggcgcgcaaaccactgccccctcggccccctcatgagccctatcgtgccatcgcctcgatcaactcacgctgcctttgcaagtctcgatcaggtgggcgcggttcagccctggaggttctcctcgacggtgaagtcatccaggtcggcaagaacagcgtcgctctctgtcgacaggccggagcggcgaacagggtggcggcgatacgcaaggccaggggcaggcccgcacaggttgacgatggctgcggctgcttcgggggcatcctgaacacgggtgtcggcgggtccgcgggcctgtaggacggcctggtgcagcagggcgctggacacgacggtgtcgaggaccttcaggtcgtgcggacgggcgtggcggcgtgacctccgggggcagcaccacggtgatgtcgcggccctggatcgcctcgtggaagaacactccgccgctgatcgcgttggacacgttcccgtcctcgccggctgttcgactcagtcttgcgtcgaccgcgtctcgccttcggcggcaggtggaggaggagcggaggcggtgaaggacaagccggagaagtcccggccctgcaacactgtcccgtactgggtaccgccgctgatcgtgttgcggacgccaccgtcaccggtacgcaccagcttcgcctgctcatgccactgttgcagaccagcagagaattccgtatccaccactgcccgcactgccagcgcggtgctcagcgcctgcgcacgcgccgcatcctcgggttcctcccgaagcctggcgagctccgcctccccggtgctgaccgctggggcctgggcggattcgccttggcgacgcccgaacgggcggcgcaccagcgtggtcagccccacccaggcctgtcgcccgagttcaccgccggcgccccctgccagcgccgcgagcaatgccaccgaaatcggatccatgctgtaccaccctccgtagctcatgctgcaccgggagtggacacactacgagaggccgcagtgcagagggcgccgatccggcaatccgccctgggacccggcagcgcccacagacagaccagacctcgccgtctacaccgagagcacgtttttcgagaccggccgttgcgaaccgccgcacaggggtacgcgacggcgttggaattgccggactccggtacctcggcggcctggcccgtcgccgccgctgtggtggctgcggtgcactcgcagttgcccgttgaaggacctcgcatcgctccagatgcgcacgctgcaccgccgacgctgctcctggcgaggccctccccgcgcagcagcctgtgtcatctggcccgtgcaaatagtgcgctgcatccagcgacaccccagcggcctcccgacgaccgccaccgccgaccgggtgtgatcctcgcctgcgccggcctcggcggtcagccggtcaacgccttcgtgttccgttcacctgcacgcgtgatccccaactcttgccgcacccggaatcatgctccatgaaccgcgtaaatctataggaaaagggcaatatgcttcgacaccgtgtcgtggtgcggcacctgacccgcgccaccgtgacctcgtgctgcgccgctgctctcgccctcacacagacggtgcaggcccacgcggcgagccgcacggtcaacttcaactaccaacacatctggaagacacccgagttcgaaacgggtatccgcggccgcatccacttcaccgtcaagaagtgcgaccaccccaacggggacatgaccgtgctgctgaggcgcactgatggcttcaactacgtcgtgggcagccggaacatcaagtgccgcgctggccacacggccaactgggacgacgatccggcggggacctacgagttcgagctcggcaagctcgacgactacaagttcttcaagggcaccgccacctactcgttcaacgccgccaggtagccgctggagccgggctcgggccggtacccggtaccgggcgccggctcccggcgcggcgaaggcacagggctcgcggccgctcgccggtccgccctcggccgtgtaccggacactccagcactcagccggccaggcccttgacggcaaggtcgtcgacgacgtgccgcagcgcggcaagcgcggggtccgccgacggatcggaggcggcgacggcggcctggatggcgcccaggacgcgggcgacgtcgagcagccggtactcctgggcacaggagatgccgaacttcgcgtcgcagtacacctcccacgagtcttccctgccaagtccagcgtgtcgacgagtgctgtcagcttgaagcgtcagccataggctcgccagggggcccaggctcgtcggctgcgggaaggctgagggtggcttggagtcctccggctgggctttggccgaggtggagggtgccatggtggagatgggcctgctgttcgacgagggcgaggccgaggccggagcccggcgcgcgggttcgcgggccgcgggtgaagcgctccttcatcgcgtggcgttggtccggggggatgccgggcccgtcgtcgctgacggtgatccggaccgtgccggcctcgtgggtgagctggatgtcgacggtgccgtcggggcggccgtggagggcggcgttgtcgagcaggttgtcaaccgccaggcgcagtcctacgggccagccggtcagcgtcgcgggggtgctgccgttgaggcgataggtggtggggtggcggcgggccgcgtggctgacagcctcgtggaggagtgcaccgaggtcgacggggacacggtcgggcagggcgtgcgcgtcgccgcgcgcgagggtctgcagcccggtgaggagggcagtgatgcggtggtgctccgcgcccatggcctccagtgcgcgggtgcgctgtggtgcggggagggtggggttgcgctggagggtctcgatggtcatgccgaggctggtgaggggggtacgtagctcgtggccggcgtcggcggtgaagcgtcgggtggcttccatgctggtgcgcagttggcgagcatgccgttcagggcgcgggagaggtcagcgacttcctgggggcctgtcacggtggggagttgggggcctgtggtgtcggcactgatggcgagcgcgccggtccgcaggcgttggagaggctggaggatgatcctggtgatcagccacacgccgacggccgtggccagagcggcggcgagggtgacggcgacgacgatggcggtgttgtcggcgacacggcgttcgatgtggtcgatgtcctggaggacttcgaggcggtcccctgtggcgttgaggggctgggtcagggtgcgccaggtctgtccgtcggcctcgatggtgctgtagccgtcacggctgggcagcgggggcggggtgggcggagtctcgccgcgctgggcgatgacctgcccgtcggagatgaggcggaccaggctctggctgccggccagcaggccgccgtagtcgtcccggccctcgtcagcaccctcgtggtccccctgccccaggagcttgtcggcgtcctggcggaccttttcggcgcgtgcggtgagctggcggtcgacgtcggtacggtcacggtggtcgatgcgggcgacgatgaccagtccggcgagcgcgaccacgaccgtcaccagtaccgcgacggcggcggtgatctgggtgcgcaggcgccgcttcacgggccggtgcgcaggacgaggccgatcccgcggacggtctgcaggatccgggggcggccgtcggcctcgagcttcttgcggaggtagccgatgaagacgtccaccacgttggtgtcgacgtcccaggtgtagccccatacctgttccagaagctgggcacgggagaggacctggccgggccggtgcgcgagggcgagcagcaggtcgaactcgcgggtggtcaggtgcaggtcccgccccgcgcgggcggccacccgccgggccggctcgatggtgacgtcgccgatgaccaggggccgtacggcggtcgactcgtgcaggcggactatcgcgtgcaggcggactatcgcgtgcaggcgggcggccagctcggcgatggagaacggcttgacgacgtagtcgtccgcgcgggccgcgagtccggcgacccggtcgtcgacctcgtcgcgggcagagagcatgcacaccggcagcgtccggccctgggctcgcaaggactgtacgacctcaacgccggacaggcccggcatcgtcacgtccaggacgatcaccgacggcagccggtcggcgacctgctccagcgcgttctcgccatcctcggcgaggcggaccgtgaagccctccagcccgagccccaggtccagtgcctcgcgtacgcccgggtcgtcgtcgacgacgagcacctccggcttcctgcctgccgccagccccggtcaggaccaggccaagcccggcgacgacacccccggcgacggcgaacacgtcggcaaacccggagagaacaagtagctctcgaagccatcgaacccgtatgccaggcgtctcaacggcggcgccgcgtacgggttcggatcgcgctcagggttttgtgaacccgcgcgcttgcgggacgagagcaccgtacgaggctggtcggcgagttgcgtgttggtggtgcgtgcgatgttcgcgcaggcgggaacacagcggtccaaggcgggtccccggtgccgacgcggtggcagagggccttgtcacggttgtagccgcacatgaggacagcgtgaattgcccgccgcgcggccggccctgacacgtcggcgcctgcggcgagatcggcgtgaagggcggcgagagtatcggcggtggctcgggcggtctcgatgccgaggagctcgtggatgccggcgtggcttcgcgctaacggtggagtcgggtatgggaactgtccgaatgcctggcggttcgcgcgttgaattcctgggtctgcgtctccgctgtggctcgggtgaggatctcgtccgcagtctccgcgggtgactgctcggaggtgtcgatccacaatccgacccggggcgtctctcgttggagaatccggtccagtggatcgatctcccatgcgttgtaggcggtcttgggtctcgcggcgtctcgtgccgctatggccttgggctgcggcacgagaacgatgacgtgcagggggcggttgcggatctgcgcgatcatctgggtgaggtggtcacccaggatgacgtcttgagcgaccacggtgaagccggcctcgaagtactggtcgatgaccttcgccgtcaggctgtgacgcagtcggagttgccgcagtgcttcgtcagatggatctgccgtcatctcggcacggccgttgatgaccatgcgccggaactggtcgccccgcacgtgcacggactgcgggagtcgttcggccagcatctgcgcaaccgtcgacttgcctgcggccgggatgccggtgatgagatagatcgcctggtcagggcgaggttcaggactggtcggctgtgtcacagggctggattctccttgatacggctgctgacgtcgacagcgtaggcggcccggtccccagcggatgcctgctgccactggacggcgactttgatgtggacgccgagcaaccgggcgaggatcgcggcggggagttcggtcgcgagagtgaacagcgcggtggagcgatccttttggggccggataccgatcttgtggagacggatgcctatctgactgtccctgaggggaaattctgtccctgaagttcttcagcccgagcggctggagcggctgcgtgcgcagatacggggcccggccgcatgggcacagggaagctccgtttgtgtcctggagcaacgttcaacccgcacgcgacgcgtggtcttcccggatccgcaggcgggttcccgtgcgtagacgtccaagaatccgggaacccggacgcttccaacagcagcaaggccgaccaggaccccagtacctggcagccgcccgcccagggctacctctgcccgccctgacctgctcggccagcccgccgaccggcagcacccggagccggtcggtgaggcggagcagacccgttatggcgacggatggctgatcgagatcagcctcaagaacccgagctccgagggcccgctgagcgcgaaggagtcgacgccttcatcgcgtccggggatcagcccccgccacgcgtggcgccggccaggccccgccccgtccctcgctccagggcgggtttacggagacgagacgcgcgcatagatggccgtatctggctggcgagttgagcgttgtcgggttcatgcgggcgccgcgcggcggcgcgctcttcatcacggaggtggcacagatgacgcagtgttccggggcggcccagcacccgatcccgcctgcggtccaggaagcgtacgggacggccgatctcagttcgatgcccttgttcggcggggggttcatcaatttcggctattggcaggacatcgacctcgaccagccgctgagcgaacatgaccggatctgcagccagcaggccctgtaccgtcacgttctcagtgctatggcgcccaccgagggactacgggcactggaggtcggctccgggctgggggttggcgccgcggtggcgctcgaggagtacggcttcgcgcacgtcaccggcatggatatccatccacagcagctcaggcgggctgaacaggccaactccgcactgctggctcgccgccccgaacggttgctcttcgcccacggcgcagccgagaacatgcccttcggcgacggcacgttcgactgcgtgtacagcgtcgaggccgcccagcacttccgcgacctcggggcattcgctcaggagaccgcacgcgtgctgcggcctggcggtcgcgccgtcgtcaccagtttcttcgtccccgacgccgatccggcccggaccgggcggctggctgaactgctcgacaccttcgccaccggcctggacgtcgcgcataccgtccccttgctgaccagcagcctcgagcgggtcggcctgacgggggtctctgtaacctcgatcggggcgtcggtgtggcccggctgggaccgctggctggcgggaatgtgggagcctggcacctggcctcgcaacttccttcgggccttccgcgaaggcaccctcgactacttcacggtcaccgcggaacgcccggcggtctgacgggcccgaatcgaccggcggctcgcgctccgcacggctcaggtcgggcggggccgggctcggttgtcgggagtcgagccggcccggacggaagtccaggtcgacgacgttcacgttcggctgtgcgaggacctcggcgtccagcgccgccgcctgtgccgccaggtcctccagggtgtagccctgtccagcgggcgggccgcgaggctgtcggggagcatctccgcatacgtggccgcctcttcgccgtagatccggccgaagtcgctcacctctggcagccgaaggaccaggcctcgatgtcgcggtagtggatcggtccgcggctacggccgacgttgctgccgaccaggtgcaggcgttcggcaggccatcggcggccggtgaatccggcgaaagtttcggcgatttcacctgccgaggatcgatctcctcggcgggctcgggccaacgtcagatgggggcgcaggggccggtcttcgaaggcgacaccgcagttcttgacggcggtacgcacatcggcagcgagcatgtgcagctcatccagatctccgtcgattccgctccacagcacccggtcgtcgaagtttccgctaccgcgtagggccagacacagtggcttgtggtccgccgcgaggtcggcgagaggcggtcgcaggagcggaactgcctcggcggacagttccccgaggaacgccagggtgatgtgccagtcttctatgcggttccaccgcatgtgcgggtgcgtggcataggcggggcgcagcgttcgggccagctcttccttcgcgtggtctggcggggcaagggcgatgaaaacccgaactgtcgtcggctgagttggatcgttcacaccggacttcgtaccgcactcgggtcgtggatgcgacagcccgggtactgcaacgcctgcgccgccttgcagcgacgccaccccagacatcgccccagccgcaatccacacgctcgccggctacgagtggatcaagaaaaactccctgggagagcaccacgatggcgttgcaactgcattgatggcgttgcaactgcattggcagtactcgagctcgccgtcggatgtcgagtggctggacagccagtgccaggacggctggcgcagagcggcggtcagccccactcctgtagcgggcaaagttcctgggcccccaagcctggcgggccgttcatctcggcggtgccgcggactgctggcggggcgggctggtcagtcgtgatcgggccgggcgtgagagagggtggcatcggtgtcgtctcccttcggatgtgccgtagccccgggctgcggcacgatgggttcgggctgcggcacgacgggttcgggaagagtgcggaacaacagccagctcagtgcgggcatgaggatgagtggcgacagggcggcctggagggatgtcgcgtcggcgaggctgccgatgagagggctcgccagaccgccgatgctgacggtcagaccgagtgtgatcccgctggcggtgccgacgcgcgagggcaggtagtcctgtccgagcgtgacctgcagcgagaacgggacgtacaggccggccgaggtcagtgccacgcacaggtacagggccggcccgggtacgaacaccacccccgcgaccgatccggctgtgagcaggtacgaccagcgggcaacggtgatccggtcccagcggtcggccagcgcgccgcccagcacagagcccaccgcgccgcccaggtagagcacgaacagcgccgcggtgcccgccgccgtgctgccgcccatgcgctccttggcgtacagcgagatgaaggtgctcaggccgacgaagacgatcgaccggcacaccacggccagcgacagcttcacgaacgaagctctgtcgtcgaccccggcccacacagccgcaccggccccggcggactgctgctgctccagcgcacgcagcacgggcagacacagcacggcaccaacgagcgccggcagcaccagcagcggcgtcaggcgcagacccccggtagcaacaacagcggcgaccatgagcggggccgccgcaaagccgaggttgccgcccacagagaaccagcccatcccaccgtggctgccccggccggcgatccgggcgacccgcgcggactcggggtgataggcagccactccgactccggacaccgccacgaacacgagggtcagcgcgtaggggccacccaccccgctcagcgcgatacccaggccgccgagcagtgtgctgaccggcagcagccagggcatcgtccagcggtcggtgaggacaccgaacaccggttgcaccaccgacgacaggagggaggcggcgagcacgatgcccgagacagcggcatagctgtaggcgcgttcggcgacgaagaacggcaccagggacgccacggcgccctggtagatgtcgacgcaggcgtgcccgacggacagcagggtgattgatgttttccttcgcaccccgtcatggtcggcgccggacaccgtgtcgcgcttccgataaactgccagacgatgacgaaaatccgccatgaaccggtcgcgccgacccgcacccagcggctggcgcccggcgccgcgatagacccccaccgccacgacgaccaccagatcgtctacgccggccgcggtgtgctggccgtcaccaccagcgccggctcctgggtcgccccgggcacccgtgcaatctgggtaccggccgggacagtgcacgcccaccaggcccacggcgagctcgaactgcacctggtggggctgcctgcggacgagaacccgctcgccctggagacaccggctgtactcgcggtgagcccactgttgcgcgaactgatcgtcgcctacacacgcacccaggacgaccacagccccgaacgggcccgcctgcgcgcggtgttgctcgaccagttgcgggcctcgccccagcagccactgcacctgcccacaccgaccgctcccctgctgcagaccctgtgcgacatcctgcgcgccgatccggccgacagccgcaccctcaccgaactgggccgcgagatcggggcgagcgaccgtaccctgtcccggttgttccgcagcgaactcggcatgaccttcccgcaatggcgcacccaactacggctccaccacgcactggtcctactggccgacagcacgcccgtgaccgcagttgcgcacctgtgcggctggtcgtccgccagcgcgttcatcgatgccttccgccgcaccttcggccacacaccgggcgcccggccgagggactgacagagcgcagcccgcgatccttgccgtggccctgctccgcccaggctcacgctttgcgggacagaacctcatggcccagggtgccgacttcccggcggaacgcgcgccggagcaagccccgccggagagccggactcagttacccacgccgaggccggacatgaacgcggacgggtatcggtcgccgcgcgccgcacccggcgggaccgccttctcgatctcggcgaggtcgtccgcggtgaggttcagctccatcgcgggcagcgcctcggccagccgctcgcgggtgcgagcgccgaccagcgcgacaatgtcctcgccctgtgcggcaacccaggcgaaggccaactgggcgacggtgcaccccttcgcctcggcgacccggcgcagcgcctccacgagggcgaggttgtgttccacgttctcgctcgagaaccgcgggctgaaggcgcggaagtcgccggggccggcgctgtgaccggcggaccagtggccggagatgaggccgcgaccgaggacgccgtacgcggtcaggccgatgccgagctcccgcagcgtgggcaggatctcagcctccaccgcgcgggacagaagcgagtactcgatctgcaggtcggcgaccgggtgtacggcgtgcgcccggcggatcgtcgcggcgtcgacctccgagaggccgatgtgccgcacgtacccggcgtcgatcatctccttgatcgcgcccaccgtctcctcgatcggcaccgccgggtccagccgggcgggacggtagatgtcgatgtggtcggtgtccagccgggtcagcgagtaggccagcaagttcttcaccgcctcggggcggccgtcctgcccgccgaactcatgacccggtccccgcagctgaccgaacttgacactcagttggtagctgtcccggtcccggccgcgcagcacctcggcgagcagcagctcgttgtggcccatgccgtagaagtcgccggtgtcgatcagcgtgacaccggcctccagcgcggcgtgcacggtggcgatactctccgcgcggtcggtcgcgccgtaagcgcccgacatgcccatcgcacccaggcccagcgcggaaacggccgggccggtgctgcccagggttcgtgtctgcatcgcgttctccttcgtcgtcggtctggcacccaccctgcgcccgcgccgcgacgtgcgggagcggagcgttcatcatgggagagccgctccctggctccgcttgcccccgcgagcgaccatggggccatgcaacgtgaccaactcgccgacttcctgcgccaccgccgcgaggcgatcagcccgggcgaggtcggtatcgccgacggcccccgccgccgcaccgccggcctgcgccgggaagaggtggccacgctcgccggcatgtcggtggactacgtcgtacgcctcgagcagggacgcagcagtcagccctcgacccagctgctcggcgcgctggcccgggcgttgcgcctctccgacgacgagcgcgaccacctgttccacctggccggccaccggcccccgcccgccgacggggtggcccgcctggctcgcgccggcatgatgcgcatgctcgatctgctcggcgacaccccggccctggtgctgtccgacctgggcgaggtcctcgcccagaaccgggcagccgtcctgctgacgggcgacctcaccggcttcctcggcgaccggcgctacgtcgtataccgctatttcaccgaccccgccgcccgcgccgtccacccgcccgaagagcgggagtaccacgcccgccagctcgtggccgacctgcgcgcggtcgccggccgccggtccggcgaccccacggtcgccggactcgtcgaccggttgcagaccgcgagcgccgacttccgccgactctgggccgagcacgaggtggcggtccggcgcgccgaccgcaagaccttccagcacccgcgggtgggccacctggtgatggactgcgagaccctggtcactcccgaccagggtcagcaactgctggtgctcaccccggcggacgccgaggcccgcgagcggctggagctgctgcgggtactcggcatcgaggaattccccgcggcggcgacggacacgcccctacggtgaagcggccgaccgcgggtcaccggccaaacccgtcacccgacccgtcggacaggccctaattctcggccgcccgcccggccgccacgtacccctggagcatcgcgccgaactcgtccgccgcgatgtcgcagtcctggaactgcccgtacaggtcgatcagccggacggtcttggtgctgacgcgctcggccgtggcggaggaggtcgccagggaaaaccccgacccccactgctgcgagtcggcgtgccacgccgccaggtacgtctcggcggccttggcggaggcgatccccagaagcagggtctccaccgcccgccggagattctcgtctccggcgggctccctggacgcgacccagtcctcgtcctcgtccagggcgaacgtccacacgaccggggcgatggaccctgtcatcacttgcctttcgggacgaaggtcaagggctggtggacacttggtgcagccctcactgcgtatttccggcgcatgacgggtcagcaaggggagacattgtctcgtctcggtacgcagagggggcggcacgaaggggccttttgcttggtgatctgcgtctctggtgggcctggccagggctcgttacggcgagttccaggcagaggtttaaggcaaggatcagtcaagtaccgaagcttcagagcacaggggcaacggtgactgcccatgccggcgaaccggaatcggcggccgcggattcgctggaggaacgcgtggaggagctgcaggatgagaatgcgcagcttcacgatgtgatgtgctcgcgcgtcgtggtggaccaggtgctccgctcatgatcgccaggacagcccctagtgctggactccgtggacgaggtgcaggtcggtggcggtggaggccgccagggcggagagttgccccgagccggccacggggggacgctgcccccgctgaggccgggcgtactgcgcgagccgctgcagcgtaccgctccttgtcgaagccgggtggccggccaccggtgctcccggcccgcagacggccggccgcttggtcggcttcccgctgcggcggccgggcgatgacctagaacagggcattcacgccttcctgaatcatcgtcaggtctgctgcgaccgcggcggtcgcgtggacgccaggggcgatgaagccaagccagcgtaggaggatgttacggcgcggctcgtcgcgggccagttccgtctgcacctgttcggcggccgcgaccagctccgccccgtcctcgtagtactcctcgttgcggcggagttcgtccagcaacaggccgaccgcggcgcacagttccgtgacggcctcggcgtgttcggccggcgtctgagtgcccgtcaccgtggcacggcccaaggcgaccatgctctgctcgattcgcacatcccggccggcctggatgccgctgacgtgccccgcctccctacgcgccccgtgagccgacatcatgtcacctctgttttaccggctgcgggttgttccactggtggccgctgcctccggcacgcacgctggagtccttgatagagatgtcgcgccccgcgaacagaccggagttgtagatggaagtctgccgctggatcaggtcgctggagtcgatgttgtggtcctccaggaactgcacgagggcgtccagcacacggtgttcgatcgtcttggcgtacaactcccggtccagcgcctggaagtaccggcagaagagccagtcgctcgcatcctcccggagactgaactccgcgccgtagtcgaaggaccgcaggcggatccaacgctcctgtcggcgttgttcgcggcgcctggcgaacggcgcacagaggtctccgaggatcgcgaagggcgcacggaccagtaggatcggggtgcgtaccccggcctcggcaactagctggcaccactgcccgaaggtgggtgaatccaacagcctgtccacggtccggtacttctcccgcactggcgcgagcagacagttgctgccctcgatgaacgcggtgtcgcggccggacagcaacgcgcatctcaagaacagggtactgactagttcgccgctccagccggtgacccggatcgccagatagggtcgcgcctggcccttgccgtcctcacgcagctcgcgcaggagtgcgtccgaaacctgcgccccgggcggtccggccaagttgcgcagcacctcgccgcgggtgcggtcgtcgattccgatcagcaggtcggccccgttgaccaggagcacatcggagatgtccatgcccggcagcttgagggccccgacccgggcggagatatgggcgttgagctcgtggatggtgaaagggatgacctgcttgcctgcctcgggacgtccggtgttcagggcgaacgaccagcttctgaaggtctccccgtgcccgacgaaaggctcgaagcgcgaggagactatgacgttgccgcggtcacggagttcgatggcctcaaggcgtgcggcatccctgacccctggtggtcggggggcgtacttcggatcgaagttttcccgcttcaacttccgggagacgacgccgtagtgcaccgaaagcaactcggcggccacgaccacccaggccacgagcagacccaggagaagagatgccccgtaagtgaacggcagagtgaccaccatgacgaccagcaggaggaggagtacgacatcccgccgctgctggcgagtgtgggcggccagggcgtgtcgcaacacgcagccaaggtccacgccgggcgaggaagcggcggcacgccgcggctcgtgcacgatccgggcgaccgccttgcgagcgagcccgatgtcggtgtgcatcgcggcgcacaggtatcgggtgacgtcgtaggagaagtgagggggtgcccccgccgcggacggcggctgcggcatgggagggggagaaatcggcgtacgcgccgtatcgcgcgcgggccgggcaggccaggtgggcggaggaggaacgggtgggcggccgcgaggtgcgccgccgtgtgggtcgacggacgggttcatcgcttctgccttagggagtcgttcaattgcgccacatacgcgttgacatactgagcgtgatcggcagatcgcctgagcgttgcccattttactccgatttgcacactctttctcaactttgattcccgtaagcccggaggtcacaggagaccaagcggtggctgcgccggacgtcccgcgtccgggcgggtggtggttcgaacggtgccggattacgaccgccggccgtccctctggcgccccggccgactggcgttaccggcctcaagtgcttacccagaagccgttgaactcgtgacgcggctgtaccggttcggtttcgacaccgtagaccacagtccgctgagcgaatcctggaccggtcagttcgtgccgccgaagattgaccggacagggatccgcggctcacctcgtggccgggtgcctgtaggtggggagagcggcctgctccgaacggcgtcggctcgcccggctcgctatggcgcgttggtgaaggagcggcggtaggaacggggcggcacaccacggcggcgcacgaactgttcgcgcaggacggccgcgcttccgtatccgacccggtgggcgatctcctcgatcgtcaggtccgtggtttccaggagttcctcggcgctgctcagtcgcaggctccggagccaggcgtgcggggtggtgccggtcgcggcggcgaagcggcgggcgaaggaccgtttgctcatcacggcgcgtcgggccagttccgcgacgggaagcggttcgtggaggtgctcacgggcccaggcgagcacctcggcgagacgctcgtcctggcagtcgtcagggacgggggaggtcaggtactgggcctgaccgccgtccctgtgggagggcagcaccatgtcgcgggcgacggcgttggccatcgcggccccgtactcccgcctcagcagatgcaggcacagatcgaagcccgcggcggctcccgcacccgtggtgatccgcccttcgtcgatgtacagggcgtcggggtccacaacgacgtccgggtggcggcgggccagcagttcggcgaatcgccagtgcgtggtggcccgtcggccgtcgagcaggccagcagcggcgagcgcgaaggtgccgacgcagtgggccgcgaccagcgagccgctctcgtgtgcggccgacagcgcgtcaagcacagcgggaccgggtggcgtacggaaaccggcccatggcaatgcgatcgccagatcagcggcagccagccggtccaggccatgcgcgaccgtgagcggcacgccgaggtcggtagggaccggcccgggccggtccgcgcacagcacgaagtcgaagccgggcagcccctccccgtgagggccgaacacctcggcaacgatgccgacggcgagcatgccgacaccagggggaacgtacgcggcaacggtcacgaagggcggcacaggagcagtgtggcacgaatggcacgaatcctgcgatgagaggcagcagtgccactcgtcagtggccgacccgcccggaaggatgggggacatgacagacgcaccgctcggccgcagcgccgtgtacacgatcctcaccaccggctacgtcggctccaccggacctggagtcgccgccaccgtctcctacgtcgccgacggcggccggcatgtggtcttcgacccgggcatggtggcgagccgcgaccacatcctcggcccgctcgcggagttggggctcggccccgacgacatcaccgatgtggtgctcagtcaccaccacccggacaacaccatgaacgtgggcctgttcggacgggccacggtccacgaccacaaggtggagtacctgggcgaccagtggaggaaccgggacgcggagggctacgaactgaccccgtcgctgcggctgatccgcacgccgggacacagcctcgaggacatcaccctgctggccggcacggacacgggcgtggtggcgttcgccggcgacctgtggtggcactcggacggccccgcggacgacccggtagccccggaccgcgaggtactccgcgcctcccggctccgcgtgctggccgccgcggacctgatcgtgcccggccacggcagccccttcaaggccgacatcaccgcgccacgctgaccagccttcggcggcaatgagtcaaggttcgctgtcacagggcaggggcgcacggctcggtgacgatcgcgaacgaggtggtcaccatcaggaccgccacggccggaggcatcgccgtgtgggtggtctggccgtgtgccatgccgttgcggatcttgcggccgtagtcgaggtactccgcctgccgggccgtcaggacccccgccccggcgccctgctcgatgagcttccgcagcggcttcttgccggcgtccgggatgcggtcgcgcagcacgatctccaccgcgatcaggaagtgcatgaccgccacggcggagaactcgtagcagacgtacgagtggcgcagcagctcgcgggccgtgtgcaggaccgtcgccgcggcctcgggtacgccgtcgggcacgggcaggtcctcagcgaggtcgtgcatgtcggcgtaactgtcgacgaagtggtgggcgctcgtccggcaccgggaacggcagccgctgggcggtgatgcgcgcagtccggcagttgcgcccaccaggcaacagcggctcttccccggggccgtggtgacgttgtgccgcagttggccagtgcttcccgaagcgcggctggtcgtggactcgtgttgcttggtcgttggccagaacgtcgcgccgtggctggccagtccacaggcgctttggtcacgcagcgcacattgaacggtctgccgcggaaggagcatcggcttaggtcactgggtgggatcatgaggaggatggccgagatacccgccctgatcaccgcccactggccggtcgcgccgtccggggagaccgactgactgctgcagttgaccaacggctgatcgagatcctcgttcaatacaggccagcgagagcggacactcgctgcctggggtactacagcccgttgatgctcggcaccaccgacttccgccctgggcccgttgaggcaactgctcgatccgtgcccgctgtcatcagtcagcgacacacccggaccaacgatcggataattcgcagaaagcagcctggttgatcccggcgggcccgtatcggaccttagcgccgggccagcgccagcacactcagaccgaacatcaggactcccagggggagatggaccgacgggacgtgcgcgatgccgagcaggacctggaccgaggcaagtacgaggaaaccggaggcgtgccagacaggccggggcgagccgccgcccggcttccacgccagcaccgcggcgagcacatacagcatcgacgccccgtacatcacacgggctccgacactgtgcagcgtctctccgtaggacgaggtcagcagcagtccggcggagaccgcctgaaggaagatggtcagggtctgcagggcgatcgcgatctgcaggaacgaggcgctgcgctgtgcgttcgctgtcgccgtcacctgagtggccatgtcacagtcctcttttccgccctcgggcagtagatcgataaggtctcaccagcccgacgacgcgggcctgcgaaaggtaaggcgagggggcggccggaagatggggactgtcgggagcaccgatgggatagccggcgagcgacaccaactgatcaatgtcgcttaccggttgctcggttcggtgaccgaggccgaggacgcggtacaggatgcctacgcacgctggtacgcgctgccacgaagtcggcaggaggagatcctgtcccccggcgcctggctgacgacggtgaccagccgcatctgcctggacctgctcggctcggcgcgggcccgtcgtgaacgctatgtcggcgcgtggctgcccgagccgctgcccgaccgcaccgagagggaccgcgcgggcggcgccggccccaccggccctgcggaccctgtcgaccagatcgtcctggacgagtcggtggccatggccttcctcgtcgtcctggagtcgatgacgcccgccgagcgggtggcgttcgtcctgcacgacgttttccggtacccgttcgccgagatcgccgacgttctcggccggacccctgcggcctgcaagcagctggcggcctccgcccggcggcgggtgagcgtcgcgcgcactccggtgacggcgaccggccaggccgacgtggtgaggcacgtcaaagaggcatgggagaccaaggacatcgcagccctcgtcgatctcctcaacccggccgccgtgatgaccgccgacggcggcggcatggtcggcacggtcctgcgcccggtcgagggcggcgcgcgcatcgcccagtacatggtggccattgccgacaaggctcctgggctcgaactcctggagcggtcggtcaacggtgtgccgggcctggtggcccagcgcgccggcgtcgtcgtgaccgtagcctctttcgacgtctccgacgggcgcgtcacccggatctgggcggtccgcaacccggagaaactgcggccgtgggcgcgggagggctagagcctgtccggcgcatcatgtgactactaggctgcgacgatggaacgcataaccgatgtgcccgagagtcccgcccagtctgccgatccggcccgggtgaatgactacgacagcttcgccgaggcgtactcggcggaaaccgagaacaacctcgtgaacgcgtactacgcgcggcccgcgatgttagccctcgccggagacgtggccggccgtcggatcctggacgccggctgcggctcgggccccctgtccgctgcactgcgcgaccgcggtgccgttgtcaccggcatcgacgccagcgccgggatgctggcgctggccaggcggcggctcggtgacgacgtagccctgcacgtggtcgacctgagcgaccgcctgccgttcgacgacggtgcgttcgacgacgtggtcgcgtcgctggtgttgcactacctggaggactgggggccgacgctggccgagttgcggcgagtgctcaggcccggcggccggctgatcgcgtcggtggaccaccctttcgtggcctacacgttccaggatcctcggcccgactactttgcgaccaccagctataccttcgactggacgttcaacgggcagtccgtcccgatgaagttctggcgcaagccattgcacgcgatgaccgatgccttcaccaccgccggtttccgcctttccgtcatcagcgagccgcagcccgacccggccgccattgagctgttccccgacgccttccatgacctttcgaccaaaacctgcttcctgttcttcgtcgtcgaggtaccgccgtcggctaccggctcggacgactactgaggttttcggttcggggtgacgaccttgcgggaccgggatcagccctcggaggttcgtagtcgtagccctccggtcgctccagctctcggtctggtcgtcgacggttgccggtcgccggtcgccggtcgccggtcgccggtcgccgggtcgaaaccacggtcgcggacggtcgtttcggtggctggatcgtggctggatccgcggcggattttctgtgtttccgctcaaggggcaagcgataagtgcggtgcgcggacacaggcacaggaggccggacatccgatctgtccggcccaagctggtggtggaagtcggcgtcgatgtcgcccgagacgcctgcggccgatggcaccatcccgcacgctggcaccttgcacgccccgacctctcccccgcctgacgtcgccacactgacacgacacggcgcgtcgggccccggccggaaccgatccgcagactccgccggcatctacgcagtggtcccgtggcgaagggccgcgggagcgggcctcaggtctgggaaggcggtgtggtgaggtcgagggtgagcggggcggtgtcgccggtgcccagccggccgagcgagaaggccatggaggcgccgacggtttctggcgtgcggaaggactccgtagtgcccacctagaggaagtgctcgcagatcgcttccggagtcgggtcttccttgaagagcatgccgtctgtggcccccaggaagatccgccccacccggcgaccggccgcgtggagcagctccccggtgcagggcacccgctcgtgggccaaaaacgccaccacagacgcgacatgccgggcggggaacagtgacgtgaggaggctggtcatctgttcgtcgccctggaccgcctccagggacatacgggtaccggcgatggggacgaccgcgttgaccttgatcccgtgcgctgcgccctcggccgccagcgaagtcgtcagccccaggacggcgcccttgcccgcggcgtagacactgagcccagtgtcgccgaacagcgcatccgagcacgtgttgacgatgcgcccgtaaccggatgcgaccatgtgcggccagaccgcacgcaacatgttcaacgtcccgcccacgtgcgtgtccagcacccggcggcactcgtcgtcggagagctccgtgagcggccgcaggatcgagatccccgcgttgttgaccacgatgtccagccgcccccactgctggtcggcggtggcaaccagtgcctgcgcgccggccgtagtggagacgtcgtgaatgtccgcgacggcctcgccgcccatcgcgaggatttcctcggccaccgcatgcgcgggcgatgctgacgacccacgaccgtcaatcccggttcccacgtcgttgaccaccaccctcgcgccccgcgtcgccaagagcatcgcgtgctcccggcccagcccacgcccagcaccggtcaccaccgctacacgacggtcgaacataagcgggtccaccgcgttcatcggtcctccccaagaaatgccctaccgggtccgcccggaagcgagcaccccacccaaatcggcccgtacgtccggcacctgcccatcggccgcgatccacgcaaggacacctgggatcccgaccggagcgggctgcccccgctcaccgtcgtcccactctggcccgcaccaaaaggtcccggcagggagcgtggcggccggaccgacgcacgcggccgcaccacccctgcccccaaacgctccggcgcgcgccgctgcgcgagcgcacgtcaactggctgcgaaccggcacacagtagcgacttccctgggacacgacggcccggctccccgggcagccttgctccggattcagcgaacccgcgcgcctcgcgtcgcgccgcactcaagggactgttcaccgagcacggactgacggcgtcgtgggcgcggtcaccgacgccctcccccacagcccgctgcctcgacgcagccgtacgcggcgatggtggcggtgtgccgaccgttcagcaggacccggcccaagtcaggctcgaccatgcggtttgatcaagcgcagcaacgtggtcttgccgcatccggaggggcccaccaggaccgcggtctctcctgacccggcctcgaagctgaggtcgtccagagccagggccccgtcgaggtagccctcgctccccggtcgaagcggatcaaccgcccttcctcgcgcgggttcaggaccgccgcttgtggtcatggcgccacgtacacgccctcccgtgagagtcgatcgcgcattaccgatgaccgggttcgccgtagtgcgcgaacagcgccagctgatcttggatccaggggttgaacgccagcagctggccctgtacccaggggtcggggcggtgcttcgcgacctggccgccgtccaggctgcgggtcgtcgtgtccgcggtcacgacaacccgcagcgcctaaagaagggcaggtccgccgtcgcagccatggagcagcggacactgcaaggaggaaagaccatgaaagaggatcacctgaatgttgacgaataggtgggcgaggtcctgaaggagcgctgagtgtgcggaatcgttccgattggctggcgcgcctgtggcagggggcgtgggtgggccgttgaagcccaggactcccggattgccggagccttggaccccgccccgtctgtgcgacccgtctgtgtgactcgacatcgggtcggactcgtcgaccgaagaagactgccggccaccgggacaggaggatcgctcctcacccgcagacgaccgagtcacccggcggaggtcaggaccgccccgcgtgccggccggagcatgctcagccgcggtaggtctccagcagccgcagccagacttcgccgagggtggggaaggcggggacggcgtgccagagccggtcgaggggcacctcgccggcgaccgcgatggtggccgagtgcaccagttccccgactccggggccggcgaaggtgacgcccaccacggtgttgcggtcggtgtcgatgagcatgcgggcccggccacggtagtcgtcgccgtactggtgggcgccggcgacgcgggcgaggtcgtagtcgacgacctcgatgcggcgtccgctctgctcggcctcgcggctggtcaggccgacggaggcgacctcgggagtggtgaagacgacctgggggacggccgcgtggtcggcggtggcgacatgcgcgccccagggggcgtcgtcgatgggctctcccttggcgcgggcgccgatgacggtgccggcgatccgggcctggtacttgccctgatgcgtcatcagggcgcggcggttgacgtcgccgacggcgtagagccagccgccgtcgacgccggtgacccggaaggtgtcgtcgacggtcagccagtcgccgggggtgagaccgacggtctccaggccgacgtcgcgggtctgcggggcgcggccggtcgccagcaggatctcgtccgcggccagctccctgccgtcggacagcgtgatccgcacctcgccgtcctcgccgccctcgcgggccatggaggtgacggtggtgctgaagcggatgtcgacgcctgcttcgcgcagtccgtcggcgaccagttcgccggcgaacggctccatccgctcgaggagcccgttctcgaggaccagcatggtcacctgggagccgagggcctgccaggcggtggccatctcgacggccaccacaccaccgccgacgacggcgaggcggtcgggcaccttgtcggcgctggtggcctcgcggctggtccaggggcgcacggtgtcgaatcctgggatgggaggcagggcggcgcgggtgccggtggagacggcgacggcgtgccgggcggtcagggcgatggtgtcgccctcagaggtctgcacggccacctccttgcagccggtgagtcggccgtggccgcgtatgaggtcgacggagaccgcgttcagccagtcggcctggtcctcgtccttccagtacgaggacatcatgtcgcggtgtgcgaggaccgcctcgacgtccagcggccccgccaccgccgggtcgagtccggggacgcggctcgcgtcggcacgtgccaccaccggccgcagcagcgccttgctcgggtcgcaggcccagaacgagcactctccgccaaggagttcgcgctccacgatcacggcgctgagccctgcggcgcgggcgcgttcggccacgttctcgccgaccggccccccgccgatgacgatcacgtcgtaggtgcgggctgtctcgttcatcactgctgcgttcctcactgctgcgttcctcattacttcgttcctcactgtttcgttcctcattgcttccgtggctcggtcggacactccggcggccgcggcccattaccggccctgtttgccgtttcccgccgccggacggccccgggctgccacgccgcacggggccgagggggcggtcgcgggttgggacggccccggcggcaaagccgtctctcggccccgcggcgctcacggcggccgctcggccggggcggccctgtggcagccgaccgccgggcggcggagagcaccctggcgctcggccggcggtccggtgccggccttcggcccgggccgcgagaaccactgggccggaccggctgccatccgggccggacacggcccgttgcagcccttggacggcggcttgtgcggtggtcagcggcctggcaggcgctgcgagacctcctggagcacccagccgttgccgtccgggtcgctgaaggtgaggaaggagccgtaggaggcgcgctcggggtgcaggccggccagccgctcctggccggggccgcggtgggtgacgtccccgccctcgtggccgtggaagacgccgcctgcgtcgtggaagatctcgctgacctcgatgccgcggccggtgagctccgcgcgggcctcctcgatgtcggagacgatgaggtacaggccctggaacgagccgggtgcgatgggggtcatcccctcgccgaagatgatcgagcactcggagccgggcggcgtgaagtgcacgatccggaagtcctcgttggccgtgtggtcgacgtccaggcggaatccgaccttctcgtagaaggccttggcccggtcgatgtcggagacgggcagcacgatcatttcgagcttcagattcatggggatgtccttgtttcttgacgtcggtggattacgcccaatgcgtcaccggttcaacaggtagtggtcacggccggggcgcgtcgccgcctcccggctgttgcggcggacggcggtgacggccggaggggtggctcgtcggcggcccgcggcgcgggataggcttattcggatcagcggtccacataagcggaccactgatccgaatatatggaccactgatccggatagtcaaggggggccgatgcgggccgacgccaggaagaaccgcgaccacctgctcgcggtagcgggcgccgccatcaccgagcagggcgtggacgtgtcgctgcgcgacatcgcgcgcagggccgaggtcggactcgcgacgctgctgcgtcacttcccgacacgcgaggcgctgctcgatgccctgctccacacgagcttcgacgagctgaccgccaaggcgggcgccctggaaacgtccagctcgcccgacgacgctctcgtttcgtggctacgcgactgcgtcgcgtggaccaccgagtaccggggcgcggtcgtgctgatggcagccgccatcgaggacaccgagtccgcactccacgcttcgtgcgtcactctgcgcgcggccggcgcgcggctcctcacccgtgcccaggccgcgggcatggcgcggaccgacatcgacggcgccgacctgttcgcgctggtggaggcgctcgcctggctcggcgaccaaccctcgctcgcgccccgcgccgatcacctcttcgccgtcgtcgcaggcgcgatcctgaccagcacagcgagcagcgataccgaggcaggaacgccaccctcgcacccgtagctgaaaccgccgcgcacgccgaccgggcgcacccagccgcacgcccggcaagagcggatcgacaccgagttagtactacagccgtagatcgtgatcttcatgcttgagcggcttgacgccggtagtggctggtctgggatcgggcctggtggcggcgtcgccagacggaccagcgaagtcggtggacagggtcaaagacggtccggttgacgagcgtgatgaacagtcgttggatctcgtcacaagtgagcggtttcagctcgtcgggcgagggatgaccctcgtgttcgttcgcgcggaggacagcgaggaaggcatgcgcgagcatggccagggtgacccagcgggaccaggacgggtagcggcggacctggtgctcgtccagggccgccaggcccttgccggactggaataactcctcgacccgccaccttgacccagcgacgcgcaccagggtggtcagcggcactgcggcaggcgagtagcagcggtagtaggcacgttcgccggtgctgcggttgcggcggatcagcagctgccggctcccgggccggggatcggtgaggtcgatggcggcccagtcgtagaagcggtggccctcggctccggcccctgcggacagcttctgccaggcgctcttgggcaccttcctggccaacatgtcggcgcgaaacctcccggcgcctgtggtgacttcgtgcgagcaggccaccgcgaggacgtagccggtgccgcgttcctccagcgcggtgcgcagcctcgggttgtcgccgtagacctcgtctcccgcgacccaggcggcccgatggccggcgtcgaggaatcgggtgaccgtgcgagcggccagctccggcttggtcgcgaactccgtattgtcaccgaggccggcggcccggcagcggtcgggatcggaggtccaggaacgcggaacatagagttcccggtccactgcggcgtgcccgcggcggccggcgtagaccaggtagacggcgacctgggcgttctcgatcctgcccgcggtgccggtgtactgccgctggactccaacggtgtcggtgcccttcttcacgtcgccggtctcgtcgaccaccagcaccgcctcgtcgtcgtgcagatgctccaccacgtagtcacccacctcgtcgcggacctggtcggcatcccacttcgccctctcgagcaggtgctgcatgtcgtccggggtcctgtccccggcccactcggcgatggtccagcagttcttgcgcggcaggtccgacaacaggccgagtaccaacttccgggcccggcgtcgggattcgacccgtgtgaagcgtcccgctatccggctcatcaggccctcgaaggcctcccgccagcaggcagggtctacgctgtgacctgcggccaccgcatgattgtttgtcttcacacaccgatgatcaacggtggccgcacccgtctccacaccgcgtcaggtcgcgcagcgtctgcctgccgtcctgtgtatcggagggcttgtgcaacgtggcgaagtctggtgggtccagttcgacgagcggaggttggtcgtactgctgtcaggagacgacgcgtccgggttccaggtgatgcaggtcgtcgctccggcgggcctcgacatcagcggtctgggcatcgaagtgacggtcggcgccggtgaagggctgccgctcgaaggcgtgctgcggctcgcgttcccgcgtccgggcttcaccccgtgcacgtggctgaccaccgtgtcccgggacgacctgatagagcgggcggccgtcctgtcctccaggaagctcagcgagatcgacgatgccctccgacttgctgaacaagcacaggagcggaccccggcaacgaccgcgaagctcagcgagataagggacgccctccgtcgcggtgaactcggttagacggagaaggagccgacgcccgcgacggcatgggcgatctcgggcgagatgatccacgctggacacctgccgcctcgacgcccctcaccatcgagatcacgatctacggctggagtattagccaaggcggtaaaagtcagctgctggaggtccggttcgcctgcccggacatcacccgggcctgcgacctcgcccgcacgttcgccgatctcatccgccatcggcgcggataccttcttctggagtggatccgccaggccgaacaggccccccaagccgatgcaaggcttcgccggcttcctccgccaggacctcgacgccgtccccgcaggcctcaccctggaatgagcgttgttcaaccggaattcgctggtcatggggctggcgtgggcaggggctgagatgctcgtgccggtcgtgggtgtgatcggtagcaggtgatcatccgacacattcccggttcgccggaatcgcgatgccgggccgggattgcctcactgctggtctgggtgatgcagcggagggtcgtgctggccgatcgcgccgaacggctgcgcaaggagctcgccgagatcgatgccgaggtggcccggctggaggcagcggaggtggtgatcgggcagttcatcgaggccgaggggaacgggcaggccgacgacccggctgtggtgcaggagttggagcgagtgacgacgactcctggtgcaggcgggatgctgctggtcccacatcgcgagccggacatggacgagagcgcgctgcgggaccagcagcatcccggcatcggcccccgccagccctgtgacctgtagctttaggtcggacggtgcctattgtcggtgcggtgcgcttcactgtccgccatggagctcacgcaagcgaccgtcaacgacctgctggcccaactcggcccaggagacagctacatgtatctgcccagcgacctggacccgcaggacctgaccgacctgctcgacggcaggtacggcgccgcgcgcacccttgtcctcgatggcttcaccgatccgacggtcgacgagtccaggggcgcggctcttctcgtccccttcgaggaccgggccgtgaagataagggcgtgggcgtacggggatcagtgggtcggcacgggtacggcacgggacgccaagggagccgagcggccggtgttggtggtcgctcacagggaagtgccagaacccttggcggtcgctccggatgaagacgaggacgtcgactggatggagcggctcatacggatcaccggctggacacggcccgcccagcggccggacgtggactgggcggaggtggaatcgcgtctgggcaccgcgctgccgagcgactacaaacgcatggtcgagacgttcggcgaaggcgccttcgacggatacctggacctgaaccaggagccgtggacggatctcagaagggacggtctgctcatctgggcgggcactgaacacgaggacctgtactgctggagggccgacggtgacgaccccgaccgctggcccgtcgtggtccggtcctttgacaacaaggacgtcccctttgactgccaggccgcgaagttcgtctgccgcatcctcatcgacccgcaccacccattcacgatggcccgctatttcgacacccactggttcatgaactaccgggaaagcggctgaccgaaccccgccgccaacggccccggctctcctccgagcctacgaggcactccagacccggcatcgcgattccggcgaaccgggaatgtgccggatgatcacccgctaccgatcacacccacgaccggcacgagcatctcagcccccgtccacgccagccccatgaccagcgaattcaggttgaacaacgctcaatggagtgcggggatcgtcgaggggcatgtgaaccgggtgaaagccctcaagagggctatgtatcgcagggcgccctttgaactcctccgcatccgcatcctcacccagccatgacagtcacgaaacttgtggcgctgggtgttcacgaacttccactgcggctcggcgtccatgtaccagggtgtgcgtcatggatggagttactgggggcactgttttcgccctgatcggtgtccttctcgggaccgtgggagccctcgtcgggcagcatctggcaacccgcgtcgaagtcaacgcgatcggcagcagcgcacggacggagtccgcgctgagcgcaaagaagccatcctgggcttcctggctgccgcgcaacgagtcgagctgatactcgatcgcagagaacttggcctgtcggctcctgaagacccacaagacgagaaactgcatgacctgtggctggcgaagaaggccattgagttggcctacacacacgacacgggccaggctgcccatgactacaccaaggcgctacatgcacccatgcgcaacaccgttgcgcctgagcttgctcccaccgaacgggactctcgctatgctcatgcaagcggcacgcgacgccttggagagcggccgcccgaggatccagcgatgatgcccaaccgactcgtcagcctctcctgcctaccctgtgatcgcgatcttggcggaactgcagacagagtcttgtaaacgacgaggggcgctcccctttcctgagttgattacgagttgatggttgtggggatggcggggagcgcagagtgcacggcggccagccaactgtgaggtcggcgggccggcagggtgcctatgctgacgcaccatggaacaggagctggagactcctttgaccggggccctgccaaggtccgcgagagcctcggctttcagcacggtgagaaccggactgacttccgggcacgtgactggtcgcccgcccagatcaccgctgcggcgcaattgctgcgccgactgcacgacgcgaccgccgacacgccgatcgcgggcggcgaggagacggtgtgccacaacggtttctccccgctcgacgtcgccttcgtcgacggccttcctgtctccgccttcgccttcgaccaggccgctcctgacccccgcatgacctcgcctgttccgcctggctgtggctactcggcgccgacatcgcccgccctctcgaccgccaactggccctgctgcgtacgttcctggacctgtacccagggcgcccgccttggcggtcagctcgtcgaagctcgtgtggagcagggcatcgagcagcgcctcgcgtgtcgggaagtgacgcagcagcgtcgcgagtccgacctcggccctgcgcgcgatgtcgcgcagcgacacgtccacgccctgctcggtgatggcggcgcccgctaccgcgagcaggtggtcgcggttcttcctggcgtcggcccgcatcggccccccttgactatccggatcagtggtccatatattcggatcagtggtccgcttatgtggaccgctgatccgaataagcctatgccgcactgcgggcaggagaaaacgatgccgacacacacgatgagggcggtccggctccatgagcacggcggccctgaagttctgcgttacgacgaggtgccgattcccgagccgggaccgggcgaggtgctcgttcgcgtgcacgcggtcggcgtcaatcctccggactggtacctgcgcgacgggctgaccaacctgcctccggagacgaggcccaagttcagcttgcccgtgattccggggacggacctgtcgggcgtcgtcgaagccgtcgccgcggacgtggacggtctctccgtcggtgatgaagtcttcggcctccttcgcttccccagcttcgacggcagcacatatgccgagtacgtggtcgcgcctgcgtcggacctcgcactcaagccggccggcatcgatcacgtgcacgccgccggggcgcccatggccgggctcaccgcgtggcagttcctgatcgagctcggccacgatcacccgtcgcccttccaggcggcacagcatcgtccggtgccactcggcgccaacatgacagtgctcatcaacggtgccgcgggcggcgtggggcacttcgcgctgcagctggcgaaatggaagggtgcacgtgtcatcgcggtggcgtcgggcgcgcatgaatcgttcctgcgcgagctcggcgccgacgagttcatcgactacaccaagagccgtcccgaggaactcgtgcacgacgtcgacctcgttctcgacgccgtcggtggccccgacagcaagcgattcctgcgcacgctcaagcgcggcggctcccagttccccgtgttcttcggcgagttcgacgaagaggagaccgtgaagctgggcgtcacagtcacaggcacccaggtccgctcgaacggcgcgcagctcgccgaactgggacgcctgctcgacgcgggcacggtccgcgtcgcgatcgacagcacgttcgcgctcgcggatgcccgagccgcgcacgaacgcgccgcccgagggcacatccagggcaagatcgtgctcacggtcgcttaggaacgagccgttccaccgacgcgtccggcactcgtccgcggggcaccggtggccatcgagacgccgatgcggagggcttggggcgcgtctttcgactaggggatgttgtgaaagtgctggtcacagccactcgttgaggactgtgaccagcaccgtcgcctctagggcggcaaggggccggtcagtgcaccagcaggttgatcacacccgtgaggtcctcctcgccgctgccctcggctaggcgacggcgcatcagctcgaagtaagggctgagcagttcgggactgacgccctgctgctcggctgtgctcaggaaggtcggcgtgccggccacctgcatggcgagagtggagacgacacccttggtgtagtcgccgctccgcagatggtcggcggtctgatgaactgccggggccatagcgacgagccagtcggcgagcatcggggcgagtgacgtggggtcgatgtcctccttgtggatcagggcaaaggcgtgtgcgaccccggcgaacatcccgtacatggcgctgagcagagccatgtcgtgcagggccgcgaagcccgcgtccatgccgacgtaggtggtgccggccgggatgcccagggtctcctggtgccgctcgaacagctcccgcgagccgctgcagaagacgtagctgccggcttccgggacgccgatcatcggagggacagccatgatcccgccgtccaggtagcgggcgccgcgttcgttggcccactcggcgcgggcgcgggcctgggcaggggtgctggtggtcaggttgaccaggtccgtgtcggccaggtcgatgccagccagcacctcgtcgaccgaagagtcgtccaacagacaaacaatgaccagggtgttcgctgcgaccgcctcagcggcgctgtccgcgacccttgcaccctcggcggcgagcgccgcggcacgggccggcgtgcggttccagacggtgagccggtggccggcggcaagccaggtacgggccagcgcggtgcccatcgcgccgagtcccagcatcgtgacgggtgtcttctcaacagcattctgtgtcatgccgattaggctggtcacaggctcgggggtgatcaagtacgcacttcggagtgggtggttaccctggggtgagcgagcacgtcaggagggtggggcatgacgacactgaaccggccgggcgcaccagacggacacgtctgcgggatcgacaccgtgatggaggtgatcggcggcaagtggaaggtgctgatcctctgggcgctccacgagcgcccccactgccgcttcggcgagctgcgtcggctgcttccggggatcaccgagaaggtgctgtcctctcacctacgcgagatggaagcggacggcgtcgtgcaccgcgtctcctacgacgaggtgccgccccgcgtcgagtactcgctgaccgaggacggcacgcgcctcaacgacgcactccagccgctggccgcctggggacgcgagcggtcgaccgctcgaggactggaagagggggcgggctaggcgtttggtgaaggtgctggtcacagccactcgtccaggacggcgaccaacacactcgcctcgtagcggacggcaagctggtcgtatctcgtgaccaccgcccagttgcgcttgaggcggttgatcccgcattcgacggcatggcgctcgcagtagctgaacgggcagccggcaggctgggcggactcaagccgggcggccggttcgaccgcacgaggatgcaggccctcatggcggccgcctggttacatgaccaaacggtgagggctgccgcgtgagcctcaactcccttactacggtgtccggatacaccagaacaccaccgccgacagcccggccgacgccggggcggcgaaaaagttggtgtgcggggccgacggaagcgggtaacgtcttcgtcatgttcttccagacgccgatttacgagtgagagcgtgatgggcccctgctgacgtccttcgacgtcgccgcccgtcccccaccgatgaatccgtagatcacttcaaaccattaccgggagaacccgtgaccgtgagcaagaacatcaacaaccccgtgggcatgggcggcggccagcgcaagaagctgtcccgcgccgaacggcagaacaacggtccgcaccggaacctcgaccgccagggtgcagccgaccagaaggcggagctggtgcgcaagatgcgcgagaaggcaggcgcagctgagggcgccgggcaggcgggcgacggctccgcacagagctgacgcaccgccgccgcagggcggcaccgcacgaggcagggcccggaccgcgacgcgcggtccgggccctgctgccgtatcggggccctgctgccgtgccgggcgcggccggtccgggtcagctctcggccgaccacccgcgtctcagctgaccacccgcggcagccgcagattcggcagcaccgtcaccgccaccaccccgagctgcaccagcagctcagcgcgttccccgtgcccagcccgggcgacaccacagccaaggcctgccccgcatcgttgaggcgggcggctgaggaagcgagggctcgccgcctaccctcaggtcatgcagccgcctcaggatccgtcgaacgtcacgcatgtccttgtggcagcctttccggcacgtcttgccggtgccgtgcagagcgtcttggcggtgatgccggacgccaggctcgcgccagcggagtcattcgaggttgttgaggtgcagggcgagaccgtcgccatcccctaccggatctacaacgaggagccggagaccggcggctcggagcggccactgaccgaaacccagcagatgatcttgcattgcctgtactcacggcacagtgatgggagggtccgccagcgccacctcgaaaagatcatggcgtcgagcgagccatgggtggtcccattcgtggtgcagttggccggcgagtacgtgctggagatccttgacgcgatcggcctgggtgttcccggcctcgctgccccggggtcggctgaccgcaggctctatggcgagttcatcgagcgcaatccagacttcttcgcacgcacggagcgacgcgtggtgagctactggtcgtgctactaccgtcggaaatatgaagtgttcgggacgtatccggggtcagcgctgatggaggcgttccgggccgccgcgtcagaacacgccggcgtgcagtggccgcggcgcacaccgccgccgtcggcgacatgttcggcgggtccgccttaggactcctcacaaaagtggtggacttgacctggtcagaagtcggtgtcgcgcacgagaccgccgggtatcgggacgcggtcagccgcgtaatcgcacgcgtcaaacccggcgacgtcggcgaccatccccgggatactggtcgcccatggatgaggtcgaagtcgttgtcgcccattccgagcgcgcgaccctgcgcgtcggcgacgtgtttctgaaggtggacgccgatcaggcgcgcatcgacgtcgaggtcgaggcgatgtccctcgcgccggtcccgaccccggaggtcctgtggcgcaagccgcccgtgctcgcgatcgccgcactcccggggacgacgcttgggcgcctcggcgggccgtcgaccgggtcgtcggcggcgtgggccgcggcgggcaccgccatccggaagctgcacgacgcgccgctgccgccccgggccggccgggccggccggagcatcgtcgcgttggcggcggaactcgacgcagagtgcgagttgctcgtgacgaacggcctcctgcccgctgacctggtcacccgcaaccgccaggtcgccgaggccgcgctccggccgtggactgcggcgttcacgcacggcgacctgcagatcgcgcacgtcttcgtcgagggcaacgaggtcacgggcatcatcgactggtccgaggcgggccagggtgatgccctgtacgacctcgccaccttcacgctcggacacgaggagcacctcgacgacgtcgtcgccggctatggcaccgacatcgacctcgacgtgatccacgcgtggtggtcgttgcgaagcctgctggtggttcgctggctgaccgagcacggcttcgacccgttcgcgccgggctgtgaggtcgacgtgctgagatcccggatgtgaggctgcgcggcccgactgctacgaccgcgttctgacgcatcgagcaggccacccccctggagcgatcgcccgcccttcctcccgacaaagtgcggtgcgcagtcgtcgccggcagatgacggcgcagccgagggtgacgaacgcgtggtggatgtcgtcgcggatctcccagcggatgcgcaggcggcggaaccagtgcagcagcgcgatcgctccttccgcgacccagcggtacacgcccaggccggagccgtgcccggtgccgcgccgggcgaggcgcggggtgatctggaaccggcggacctgtcctggtagacctcgtggtcatagccgcggtcggcgtacagatacctggggcggctcagtggctggccgcgcttgccgccgatcggcgggacggcctggatcagcgggatcagttgctgacgtcgttgcggttgccgccggtggtgattgccgcgagcgggatgccgtgcgcctcgaccatcaggtggtgcttgctgccgaccttgcccccggccaccagggacggaccggcggccggcccacacttcatcgcgcggatgtggccggggtcgaccgctgcgcgggaggggtccagcaggtctgcggcccgcagctcggacagcagcagctcgtgccggcgctgccacaccccggcctcgttccagtcccgcagccgtcgccagcaggtcatccccgagccgatgcccagctgtcgtccaggtcgtaggcgtctggatagtcgcaggatgctgccagcatcaacgagaactgacaggccgtcattcccggaggtccagaaacctccttttgtcaggagtcgtaagcgcagtcgtcgtcctacccggcgagggcgaaattgtgtaggcgggcgatgccgagcatggcgtggtggacgccgtcgccattgaggcggcagtcgcgcaggatcttccaggtcttcatgcgggcgaagacatgctcgacacgggcgccgacttgcctgtgcgagcggttgtgcgcctctatccaggccacgagctcggcttccctctttcacggcggtgagggatgaggagcccggtgccctggtagccaccgtcggggatggtgaccgcgtggcccacagcggccttggcgccggatcccgcccatgccttgcagtcgtcgcggttaccggggtagtggtcggccgatcacgacgaccaggcgactgtcggcgtcaatgaccacctgatggttggtggagtgccgatagttcttggactgcttggccaccgtgcggtcgcgagtgggcaccaaagtgccgtccacgatcagcacagcgtcattccggaaacgtctgcggggttggagagcgagatgcggaccgagctggtcgatgacctggtcggcagcggacttccagccaccgaagaggggtgccaactggcgcatcgtcaagttggtacgccagtacgttacgaccagcatgacccggtcctggaacggcggccccagggccgtccgcagcggaccacatcggcgccctcgcgccgcagtgcgctcaccagcccccggagctgtcgcggacgcggactcggccccgtgaactgggctatccacgaaggctccgccgctgagatcacaccaggcacgccagacacaccaagatcatctcactcgtcagtcattgcgggacaagcctcagcgcgtggctcgcactgaacgctgcccggcgtgccccagcagcccgtccggcgagcccgctgcatgcgccgcggccccggtgccagaggcagccgggtccttgatgcgcgggcgcgccgggggcttcttggcgccctcaccgacgacggcgccatcgccaccgtggtcatcggctccgaccgccaggtcgtgtgagcctgctccttcaacgaccacctgctccttcgacgagggcctgctccttcaacaacggcacctgggcaccgaaacagatcaccctgcccgaggatctcctgaccgtgcccgccaccggcgaggccgggcacggcactggccgcaccggtgggagcagcacgtcaccagccggctctgtgcgcagcctcacagcgctcgcacctgccaggaacacgtcgggcccggtcctccggtgggagggccgggaactcgcgcgtttggcgtaggggggtcgcctgtcagggccacagcgctgtggtgaacagatttttcaaccctgcatcgggtacacggcgtcagggcggacagccgctccgcccagtgaccggcgtgaaggagaacctgatggacgggatcgtcctgctcaaagacgaccacaagacggtggagaagctgttcaagcagttcgagaaggccggcgacactgcccacaccgaaaagcggaagatcgccgaccaggtgatccaggaactcaccacccacacctggatcgaggagaaagtcttctacccggctgcccgggaagccgcaccggacaccaaagaccatgtcctggaaagcatcgaggagcaccatgtcgtgctgtggatgctgtccgaactcaagaacctcgatccggccgacgagcggttcgacgccaagatgactgtcctcatcgagaacgtacgccaccacgtcgaggaagaagagaaggagtggttccccgaggtccgcaaggccatgggccgcaaccgcctcaccgaactcggcgagcagatggaggaggcaaagaagaaggccccccatgaccccttggccgtacccagcgccgacgaatagtccctccgctctcgcacctcacaggcctcggcagcacggcacacgtcccgtcatgctttgcttcccgaagccacccgctcgggcttcgaggggggtggggcggcggctcatgtcacgcggtagcgggcggcagttgctggcgcagggggaggccgagtcctggtgtgccgtccgtgccgggtctgaatgaagtcggataccttgatcgacactgcgagttccttccgatccgttggtgatgcgagcacgaagactgctgctaatcctcagagccggagccggcggatgaccgcgtacgttcctgctgtcgcggcggccggtgcggtggcgagcgccgcggctgcggtcagccgggcgtcacagacgcggacggaagggcgcggggcaagcttttccgggtggccggcgggggcgggaccattgaggccgagcgccagggcctcggccagatgcatcgcctgccgtcctgtgtctccttgggtgatccgagtgcggcagctgaacccgtcggcgacgatcatcgcgcggggagcggcgttgcgggcggcgccgaacacgtgatgcggcacagcttggcgccgcaggccgtgccgcaacccgcgtgacagcagccacgagcgtctggccgggcacgttgcacaccccggtgcttcttcctgagcacccgctcttcgaacgctccgccatgcgagagggccggactcgctcgccctgtgacggggacacaggagacaagagccgtcgtggcgaccagatcggtgcagtgccaagcccccgcaacccgcatcggcgcacaccgcccggccagctgtgactgctcgtgtcacggcgccctcgagaaagacctggacctcggccagccgccatccaagcgaatccgtccgcgttcaccaacctgggctgccggcagcgaccgaagcgacaaagaaggccaagcgcacactcaccccaaagcgagtagcagcagggatcacactcagtgatcctccaggatgcgcgcacccgaggggactgcttcgctggtcaggcccgctctccccgttcacaaaggagtgatcatgagcgcaacagaccctacccgtggttctgcccagcaaatgcggcagaaggtccaggagatggaagaggccgcccagcgcgcctccgaccctcaggagcgccagaagctgcaggacaaggcccgcaagctgcgcgagcagagcgagcggcagggcggccagtctgagggcatcgaccccacgatctgacacccccgcacgacgccggccggcagactgtcgcatacccctcccccgcgacggactgccggccggtccgcgtagccgccgtgccgagggcagcatcctccaacctcacaaggcctgtccacgggcacccgctgggacgcagagccgggccaggggcgcgcgcgagcaacgggattcatggacaacgcctggagtcggtcacctctgccgacccgacggctcgaccagtctcactccagcagctcttggtgccccaaccgaccgaacgcccatcccccaggggcgttcgccggcggccacggtcactgcgcgaacaagagtcgtccgggcgcactgcagacggctgccgacctttaagggggcttctgatctgggtagttggtgttctgggatgtctttgtgactggcgccgttggtggttgttgcatggggtgtgagtgttcgtccgcgtaatagtcgtagacggtcttgaaaggcgggaagtcgtgccgcaggtactcccacgggatgccggtgcggttgacgtagaggatcgcgttgacgatctctcgcaggtcgtgcacccgggccgctgtgccgggtccggcccaagcccagcgggcgtcggacacgtcactgcggtacgggcggaagtgggaatcggacggcacgacccagcaggtcctcgacccgctacgcgacaagacccggcgggcgcaaggccacagtgcggggcccaccgcggccgtggtggacgcgcagagcgtgaagacgtcggcaaacgtcgccgagaccagccagggcatcgacgccggcaagaagatcaaaggacgcaagcgccacctcatcaccgccacgtttccggtctggtcctggctgtcctcgtcactgccgcgaacgtgcacgacaccaccggcggcaaacaactgctcgacgacctggccgcagcacctcccagtgtgaccaaggtctgggccgacggcggctaccagaacagcatcttcaaccacggcgccgggctgggcagcgatgtcgaggtggtgcaggggccgcgcgccaaagggttcgagccgctgccgaagcggtgggtgatcgagcggaccttcggctggtcgatgcagcaccgccgcccggcgcgggactccgagccctcccgcaaagatcccgcacgatgatccactgggcgatggctaacgaaatgtcccacgaactgaccggggaatccacagcaacctcgcgaatcgaaacagacatcccactcgcaacaggctgaactttgatcagatgctctctaggagctcgtaccagggtcagggctgtcacggcccgccggaagagcgctgacgatgctcgctctcgcgcacctcttgggtgtggcggccgatgtcggtgacgcgatccgcgaggtcgggatgagcggagcgcaggtgagggcctgcctcgttgaggggacccaggagttgggccggatcgctgttcccgagtgcggtgtgcagagccgtgagcgcgtccgtcgcggcgaggggaagatccggcagagcggtgatggtcccggcgagctggcgcagcgcggcggcgtgttcatgggcccaggacgctacggagcggtccgcggcacgtcggccgcgggtggcctgtacgcgctgttccttggtggtgccggtttcaccgggacgcacgcgcaggtagcggcgctcggcagcctggcggctggagacgccgagggggtgggccaggtcggcccagctggcgccggccttgcgggccgtttcgatcagttggggctcccagcgggccagctgttcacgtacttcgcgcaggagcagcagcgctgctatggcctgctgggggtcgtcggtggaggcgacgtcggcggtgtgtgctgtgcgcatggcctgggcgatggcctcgatggcggtggccgtggccgtgaaggaggccggtgtgggagtgctgtcgtcgctcatcgcctctccttcgcaggtcgatgccgttcatgggcccgtcatccgttggatgacatgcagcttgtcgtcgttcagatgacatgctacaacggagtcaggtgaagcgcattggcagcaactgcctgaactcatctggaggtgtttaccgtgttgatgcgcaccgacccgttccgtgaactcgaccggctggcccagcatctgatgggtccgggaacgtggtcccggccttccgcgatgccgatggacgcctaccgagacggcgaccagtacgtcatcgccttcgacctgccgggcatcgaccccgacgcgctcgacatcgacgtcgagcggaacatgctcaccgtgagggcggagcgacgccccctgccgaggtccgagagcgcccagacggaactgtccgaacggcctctgggtgtcttctcccgccagctcgtcctggccgacacgctcgacaccgagcgcatctgcgcggactacgaggccggcgtcctgaccctgcgtatcccgatcgccgagcgagccaagccccgcaagatcagcgtccgcagcaccggcgaacgccaggagctcgacggctgatccgccgctcgcaagtccgccgaccgggcccaggacgaattcgcccacgatcccgccctgggccccggcggccccggccccctcgctccacgccggaaagcccgtcctcgcaaggaatgcggttcacgcgaggaaaccggtccaccgcaggaaatcagtccacgcaaggaaagtcgtcgcgcctcatgaccctcgtctctcccaccgcgccctcggccccgaagacaactgtcaccttcgtccagatgctggaaaaggtgcgctacgaaggcgcctaccccacccgccgacaggcacaagacgtcctacgccgtgtccttgaggccctcggccgccagctgacaggtgacgagcgcgtggaactcgccgcccgtctcccccgggaagcagccggcttcctcgcctcgcagatccccaccagccagccactgaccggctggggcttcgtgaaagacctcgccgaacgaacgggcggcactctggcgacgacccgctgggacaccggaacggtcctcggcgtcctcgcccgcctcgccggtgacgacctgaccgcccggatcatcgggcaactccccgacggctacgccctgctgttcggacgggcccaactcgtccgggccgcctgaccgcccggccaaagccaacaccgtcaccggacaagaacggcacacatgtccgcggtgaccgtcatggccgtagtgcccgcgcccggctgcggcggcggccactaccttcacccaccgctggcctctgccccagctgactcgacacccggcctgccccgcatcaacgacgacaacgtggcagccatggccgcatgaccagacagcagccacgcccagcaggctccggcgcccgtacagggtgacgaagacagggcacgctccggatgaacgacgcagcgcctctgcttggctgcgggctgggcgcgttgtgggtaccgacagcacagatcccggcagccaacgggctgccgggatcaaaagtggtgcgcctacttggacttgagctgcttaatcctcgggcttcagcccgaggttgtagatggcgttgaggatcagcaggccgccggtcaacgcggggactgcccactggaggaacgtcaggtgacgctgcgctgtgtcggtgtcgagggggtgttcggcggccctctccgcgttctcgggacggtcggaggaggcaagctcgagcttcttgcccagtacgcgactggaggccgtggccgccagcgccgctccggtcaggaccgtcttggccagcgtcgagggtgccccttgcctgctcggttggtgcgaacggcctcatcctcgtcacgctccagcccactcgattgccgcattcagggcggggacttcgccgccgatatcgcagtgatgcacccacaaccgccaacgccgacgacccatcacctgcctcgggcgcgcagctcctccagcccggctgccagccacctcgcgcccgatacctcgcgagacctggctttcgaagagtgtgacctcatgttgcgcgtcgtcgaggaactctgcgcccgcggactggtcacagtgggcgccgctcagactctaggtgatgtcacccagtttgtcgtcggcctttccgccgggttctccgcctgggcgcccaaaaggctcttgaacgccacacgcagctggtccagttccgagccctgatcgcctccggcgtcacgtgccgtgtcggccttgggtctacctccgccgccgtgaggatgccttctttgccgctgtcttcttggctgcggacttcttcacaggggacttcttcggcgaagccgaggacttcctcgccgctgacgtcttcttcgcgggagccgacttcttggcaggtgccttgcgggcagcggccctctcaggacgacgcgcgccgcctcgaccgcgccgagaacccccatcgctgtcgtcgtccggcttccgagctgcgcggcgacgccgggaagcgggcctttccggctcctcttcttcctccggctcctcttcttcctccggctcctcttcttcctccggctcctgttcgccttcaggctcctcctcgtcctcccccggctcctcctccggttcttcttcctcgtcctcttcgtactcgtcctcggcttcctccccctctccttcttcgggctcttcgccctccggcacttcctcttcctcgtctccctcctccggctcttcgtcgtcctgcggctcctccttgcccttgctgcccatgcgctcggtgcgctggtgcagggagtcggccagatcggcgagtttgcggtcggccgccgtggtcatcgccttccgcccggcctcgagtacctcaccgcggagctgctcgttgaggtcggcgaactgggggagctcacgcagcctcttgacgccctccgccaacagttgctgtggttccagcccgaaccggcggccggccaggtaagtcgccatcgcgaacgcgactcgtcccttcttcgtccggcccacgacatacccgccgagaactgcggcggcaagagcgatcttgggtacatcagccatcagatttcccttcaaagggctaccgagcagacgcttcggctggcgagtggcgcccgcacacgggccccgcacctcgcaggcagaggactccaatggagcagcggccggtggccgcgctcgtcgctccgccccttcccagtctgggcggtgcttccagcagccgcatgcggagaacagaacgtcacagggccgcaaccgcgaggctgcccatgcgtgcggcgcgctgggccaggagctcgctctcgtcgcgctgcccgccacaaccctggcggcctggattgtggcgggccatgatccggcgcaggtgcgcttcgtcggtgagcacctgcccgaggaagacggagtaccgggcaaagtcagcgagccgatgctcggcttcgtccccggccggaccggtcaaccgaagacgggcggtgtcggccccgagatcaggtgtcgaccgcgggcgagcgcgtcttcggcctggacctcggcacggaagccggaagggcgttgcgcagcaggaacgggcgtgcgcatggtctgcacagtgctgcctctggcgggcaccatgccgtcgagccgcagctgccggatggctgccgatcaccacggatcaagtggcgggaaggagtcgtcctttcacacgaacagggcggcgtacgccgacgcgggtcggtgtacgccgccctggggcgggacgagtggcgggaggtggcccgcgctgtcatgtcggctatttggggtcgcggttgaactgcgccttcgaccagcggtggccgaggacggtcaggcccaggcaccaggcgagggcgatccaccagttgttgccgatctcggtgcccagcaggagtccgcgcagggtctcgatggcgggggtgaagggctggtactcggcgatcggctggaaccagccgggcatggagtccagcgggacgaaggcgctggagatgaggggcagcaggatcagcggcatggcgttgttgctggcggcttcggcgttggggctgcccaggcccatgccgactgcgatccaggtgaacgccagggcgaacagcgcgagcaacccgaatgctgccagccattccaggacggtggcatccgtggagcggaagcccatggcgacgccgacggccccgacgaggaccacgctcatgatcgcttgcagcacgctgccggcgacgtgcccgaacagcacggagctgcggtggatggccatggtgcggaagcgggcgatgatgccttcgttcatgtcggtggagaccgagacggcggtgccgatcgtggtggagccgatggtcatcaacaggatgccggggacgatgtaggcgatgtaggcggagcggcccgcgccgccgctcatggtgtcgccgaagatgtacacgaacagcagcaacagcatgaccggagtgagcagcaggttcagggtgagcgacggatagcggcgggcgtgcaggaggttgcggcgcagcatcgtggaggagtcgcgtaccgcgagggagaaggagctcatcggacagcctccttgggctggttcggctgggcgggcacggtggtggagccggtgagagcgaagaagacgtcgtcgaggtcgggggtgtgcacggtcagctcgtcggcctcgatgccggcggcgtccagctggtcgaggagggagcgcagtgcgcgctggctgccgtcgctggggatctgcagcgacagcgcttcgtcgtcgcgggtgccctcgcgcagtgccgaggcggcggactggtaggcggccgggtcggtgaagcggaggcggacgtgtccgccggggacgatccgcttcagctcgtcggcggtgccctgggcggcgatcttcccgtcgctcaatacggcgatgcggtcggcgagttcgtcggcttcttcgaggtactgggtggtgaggaagacggtgacgccgcccgtgacgagctcgcggatgatctgccacatgttgtggcgggagcgggggtcgaggccggtggtcggttcgtcgaggaagatgatccgcgggctgccgaccagggtcatcgcgatgtccaggcggcgcttcatgccgccggagtaggtggaagcgggcttctttgcggcttccaccaggtcgaagcgttccaggagttccgcggtgacgcgctgtccctcggacttgggcaggtggtgcaggtctgccatgaggagcatgttctcctcgccggtgatcagcccgtcgacggcggagaactgcccggtgacaccgatcgcggcccgcacggcatgtgcctctgcggccaggtcgtggcccgcgacctgggcctgcccgccgtcggcggtgatgagcgtggacaggatcttcacggcggtggtcttgccggcaccgttgggcccgagcagcgcgaacaccgacccggccgggatgctcagatcgatgccgtcgaggacggtcttgtcgccgtaggacttgcgcagcccgttcgccgcgatggccaggttggtcatgagggatgctcctgttcagggaccgccggcggtggtgtcgccgtgggtcagaggctgcgggcggtgatgtcgccgtgggcggtggtcgcgtggatggtcaggccggcggccgccccgtcggtgttctggagcgtgttgttgatccggccgtaggaggtgccggcgtccagggcggcggagactccgcgggcggcaccgacgacgatgtcgcccatctgggtgctcagcgtgagcgtgccgcgggcggcctcggcgatgttcaggtcgcccttctgggtgctgatctcgccgggcccgttcaggcggccgaccgtgatgtcggcgtcgaggccggtgaggcgggcgcttgcggcctcgtcgagcttgaccgagcggtagccgcccgcgaagacgacgtcaccgagtcgtccgacgccgcggaattcggcggcggccgccttcgcctcgatgtgggagccggcgggcagctggacggtgacctcgacggatccggagtgtccgagggcccggttcttggcctgcggggccccgatccgcaggacgccgtcgctgtaggagaccgtgatctcttcggctgccttcacatcgcggctcttggcggcgttcgcgggcaggacctcgatggtggtgtcggcccggtcggcggcaatgaactggatgcgtcccgcggggatgtcgacgacggcggagaccggggcgggggtgtcgaacttctgcatcgtgtgctccttgttctgtgttgcgcgcccttgcggcccgcttttccaacggcagaaacgctacgttgcattcaaggttctggcaacagagtcattgcgcaagattttcatcatcgcaggtcaacactcaaaacttgttgcaatgacctcacgcctaacgcaacaccctcgcctggggatcgttgcaatgaattgagagtgaacgctatagtgggggacatcgcagaccgacgaaggagaccgtgatgccgggaggcagactcacccaggaggaacgccagcagatcgcgctgggactggccgacggcctcgcctacgcggagatcgcccgaggcatcgaccgtccgacctcgacggtcacgcgtgaggtgatgcgcaacggcggccccaccgcctaccgcgccgacctcgcccaccgcgccaccgaacaccgcgcccaccggcgcaggcaggccgcgccccgggacccgaaggcgcccccgcagccctacggacgcgacgaggaagcggtgcgcgagtacgaggaggtgttcaccaccgtcatcatggcttcgggcgcgcccaagatgatgtcccgggtgctggcctgtctcttcaccaccgacgcgggcagcctcaccgcgtccgaactcgcccagcgccttcaggtcagcccggcgtccatttccaaagcgatcgcgttcctggagagccagggcctcgtccgccgggaacgcgacgaacgccgccgagagcgctacgtcgtcgacgacgacgtctggtaccagtccatgatggccagcgcccgctccaccgcccaactcgtcgaaacctcacggcagggcgtcagcatcctcggccccggcacccccgccgccatccgcctcgagaacatcgcccgcttcctcgacttcgtctccgaaagcatcgcccgcgccgcggaacaggcccgcgaaatcctccacacgaaacccggaacaaccccagacagcaccacctgagccaccatcaggtcgccggcagaaaggcaagcacgcgcccgccggacagctttcacccgcggcagcaagagcatgaaccgcctgcccgtcgcgtcacggcgcattctccaggacgcctgatcgggcacacctggtgcacatgcccgggcggtccgttgtcagaggcggacgacgaccagggcgatgtcgtcgcggccgccaccggcgacgccgagccccgcgagcagggcgtccgcaagccgctcgggaacgaggtcggtcaagccgcccagcgtttccccgagccggtccaggccggtgtcgatgtcctccccccggcgctcgatcagcccgtcggtgtacaggacgagggcgtcaccacggcgataaggggcgctggcctgcgggcgcggcacaggctcgggccgcgcacccagcggcggatcggtggccttgtccagcagttcgcacgtgccgtcggcgtgcaagagcaccggcggagggtggccggcgctggagtagaccagcagtttcgaccgggagtcaatgagcaccgtgaccgcggtggccgcgagtgcgccctccaccgagcgggcgtacatgcccagcacctccaaggcctgggcgggcccggccaccccccggctcgccgcagacagggcgctgcggagcatgcccatgatggtggcggcctccagaccgtgcccgacgacgtcaccgacggcaacggtgaaccgcccctcggtcaggtcaacggtgtcgtaccagtcgccgcacacgttcaaagagccgatcgcaggcaggtaccgcaccgccacattttcatgacgggccagatccggggagtgcagcatcgcctcctgcaatgtgaccgcgacttcccgctccctcgcgtgcgccgcccgcaactcctcattcagccgctgcagctcacgggcccgggcatacagctcggcctccatcccctcctcccgctcggacagccgcccgccctccccgcggctccgaaagcggcgggcctgcacaaacgcggtcacgtcctccacccggtggatgatccacgccacatgcccgtcccggtcaacaacgggggtgttcaccggcgaccaccagcgctcctcgaacacccccggccgcgcgaccacggggatgtcgtacttctgcaccgccatcacgtccgcggaccccgtggccagtacccgctccaacgaggcccccagattccgcaccccgtcggcatccgggtcggccgggttgtccgggaacgcctcgaacacatgctggccgaccaagtcctcccgggtacggccggtcgcccgcagatacgcctcattgacatccacgatcaccagatctggcgccagcaccagatacgggctcggcgtcgcgccgaacagcaacctgtagtccagctcgggcctcacacgcttccgccccgtgcgcatcctcggcctcggcggccctatatcttccacgctacgcagcatcagcacgctccgcacggcgtggcgcccacccgaggcggacggggcgggcgcgccgttccttcggcggcggggcgggctcgtggcgcggtcgacagctcggtgtctcccgcgcggggcaggccggctcggggcggtccggtgcccagcgggcggcggtgatcggtcatcggccggttcttccctggcctccccgggggccctccgggacccgccagcgccgggccggtattgcgccagggagtctccgggccggccgacggccgtcaccgacgacgacctggcgcagggagtactggtacatctgcctggcgctgatcttcgcgatatccatcacgcaggccacgcgttccccaactgggaacccatcgcagcgcgagcgtcggcgaacccgcggcgaccgcccagcgccctgccccctccgtgcattccgtcagcccgtgcgtggcatttcgtcgattcctcgaaatcggccagtacggtctcgccatcactctccagcagggcggacaaaactcttttttcgggtacgcggacatgggtgccgccgtcggtggccgacaaggaacgaggacggaaatgcgtgacatcggtagtgtcggcgggcacagctcccctcctggcacaccactgcgcggacgggtcgcagtcgtgaccggcgccgcacgcggagtcggtgaggccctggcacagcgcctgtccgccgccggaatgctcgtcgcactgctcgggcgcgaggaggagaccctgcggcgggcggccgcctccttgccgaaccgaaacatctacgtcgaagccgacgtcaccgaccacgccgcgctcgaggacgccgcccgacatgtggacaacgaactgggcccggcaagcgtggtcgtagccaacgccggcatcgccgccggcggtccattcacccgcaccgcggccgacctgtggcagcgggtcatcgatgtcaacctcgtcggatccgccaacaccgccagagccttcctcccgcagctcacccacacccgcggctacttcctccagatcgcctccacggccgccttcggctccgcacccatgatgagcgcctactgcgcctccaaagccggcgcagaatccttcgcccaggcactgcgcggcgaggtcgagcgcgacggcatcaccgtcggcatcgcctatctccactggaccggcactgccatggtcgccggcatcgacgaccaccccgtcctgcaagccctgcgacggaaccagccccgcttcgcacgccgagtccacacccccgcccaggtcgccgactggctcaccaccggcatcacccaccgcgcccaccacatctacgcaccaccctggctgcgctggtgccagcctctgcggccgctcttccccgcggtcgtcgcccggatcacccggcgcgaactgcggacccgttcccacaccgagctggcagccgacgtcacggtcctgggcgccggcggtctcgccgactggaactccttcctgtcccgcaaacacctctaggcgtggaaagaccctgggcgacgacgccggttcatcgggttctctctgtaacgcttttcgtgcctcgaaccaagaacaagtgaagtgcctttgaagaactccggtacacctccgacgaggaggaccgggatgcctccgacgagaaggagtcgcctgtggatggcgcggaacggttacggggtgggcccgccgcagcagtacgtgacccgcagctcttcgaagagttctaccggcggcacgtggacgcggtgatgcgtttcgtggcccggcgcgtcgacgacccgcacaccgcggccgacctgacggccgaaatcttcctcgccgtcctcgactcggtccatacctatcgcccacacctcggcagcgagactgcctggctgtacggcatcgcgcgcaacgtcgtgtcgtcggagcgccgccgggtcgcgcgggaggcggaacgcgatctgcgcttctccggacggcggttgctggaggctgacgacatcgtccgccttgaggacaggctcgacgcggagagccccggccggcatgccctggcggcgctggcgagacttcccgagggcgagcgggccgtcatggagctcgtcgcggtggatcagctcacggtcacggaggcggcggccgcgctgggcatacgccaggtcacggcccgggtccggctgcaccgggcgcgcaaggccctgcgggaggaggcggacgtcaaggccgcgaagacgaatcccgtggccgcgcaggcaagctccccgggagcggagacgccggacgcatcgctgttgtacgtcacaaggggagaagcatgagcatgaggacgacgttcgaggaccggctactgggtgagctgaagcgggagatcgagctgcgcgaggccggagtagccagcaccggaacggctgagttcaagacgggcgagggcagggcgaaggctgccgtgggtcgtctgttcgctccgctcactccgcgccggatggctgccgttgcggcggcctgtacagcggcctggctcgccgcggtgatcatgcccggttcgccggccggctcgaacgcgtgggcggtggatccggtcggagacggcagcgtcaagctcaccgtccaggaccagaacatcagtgtcgcggcccagcgcgagctcgcgaggaaggtgcgcccatggggcgttcacgtgaccgttgacgtgctcgctcccggctacgtctgtgagcgcagcaaagtcgcctctccgctcgtggcgagtgatgaacacggcaaccgtgtacccgtcattccttttaagtccagctgggacgtcacactgcgccggggcaacgtgctgaccttcgagaacaccaaaggcagctcccagcctcgcgcggtcgagttctacgagaccaggagcgaggccgagccctgcgttccgatgaaggttgtcctgccggacgactagccgacggaattcacaaagtcgcgtcgacgaccgcggagccgtggttccccgggccgcaaggcaaccaggggaaccgcacatgacgcacgatcagcctgcagcgcggacgatgggcatggcgaattcgcccccacctcttgcccctgcttggaccaagcacagccgctgaagatcacacgggtgcccgcggtgtaaagcgcctcatcaggcgtgtcctgtcttcgccaccctgtggccgcatcttcgacggccggatcaaaggctacgtatggaacccccacccctcgtccctccttccccaaatcggacacgctctgtaatgcaacaactacccccagctaccatgtcggccggtctgtcgcggttgggctggctggatgcgttgcgcggcatcgcggcactggttgtggtgttcgaccactcttcgtacgccttcatggcggagttccggcgggagttgatgccgcagttcaacaccagccggtacggcatcatggtgttcttcctggtgagcggctacatcatccccgcgtcgctggaacgccggggctgtgtccggacgttctggatcggacgagtattccgcatgtacccactgtgggcggttgccgtcaccgcggtcctcgccctccacctgatgggaatcgccgagattcgcaccggcttgggcaggcagagccttgccgccgtgaccgtcgcccatgtcaccttgctccaagagctgctggggacgcccagtctccttcttgtcctgtggacgctctcgtatgagatggccttctacctgctggtggttgctctcttcacggtccgccttcatcggcggtcggcagcggtcgccgtcaccctggccgtgctcgccgccgtatgcgggacggcaggggtcgtgctgccggtctccgccctctctggcgcggtgggcaccggcccgctggtcgcggttgcctcgatcaccatggtggtcgccctctgctgtgcgagtgccgtgtcacccgcgcttcgcgtgttcgggggcgtgttgggcggggtgctggcgcttgtcctggcccccttcaacggcacggtccctctgtgggagggcctggtgatccttgccgtgatgttcctcggcaccgccgcctaccgggccgagcacggtcagagcacctggcggtacgctgcgtgcacagccgtcgtggtggtggcctgcgcggtggggagtgcgtaccgatacggcgacgggcctcatttcacacggcgcggctggatcgtggcattcctgctggcagtgctcaccttcggtgccggactggcgttgcgccgccggcgggtaccgcgctggctgaccgggctgggaacgatcagttactcggtctatctggtgcatccggtgctgttggcggtgaccgacggcacgatcggccggtggcggcgggacaatctcatgctcgaagtggcgttcttcgccgtgctgcttcccctgtgcgtgctgacttaccgttacatcgaagcaccaagccagacatggggccgaaagctggaacaccgcgcttagccgccgtgccgaaggcccgtgccgcatgcgtccccccatcctgtccggagcaccgcagcgccccggaccgatcaaggtcgagggcactttgacggcagataggggtcagcgggcgttgccccgggctcacaccggtcaaggccgcgttccccagaggctcgccgttggccaggtcgcggttcatgactcctgtatgtccggcgccggtgaaaccgttgcaccggccgccaacagtctctccgccagcgcgcggcagcggcccccgagctccggaggatcgagtatctcgaagtcgtaccccagcaggagtacgtgcatgagcacggcgtcgaggctggcggcggtacggctcgacccgccgccgtcgtacttcgcttccggacgggtagtcgaaaccggcttcgacctcgtcgcggcaggccctggcaagcgccatgagcgcctcggggccgaccggcgtgcggcctgcgccgaagaactccaccgagctggagagcgcgcgcacctcaggccgcaaccgggcgggcagcacctggtcgagcttggtcagcgcccggagcgcggcgtcgccggagccggcgaccgcgccacgcgcaccgacgagcagcgagaccgcggtggcggtcgcctcctcgtcgtcgagaagcagtggcgtcgggaggagcaacctcgggctcagggtgctcgattaggctgatggggcagcctacgaggaggagttaccaagccgatgatcaggctctcgctgcccatcaccactgaacggctcacactgcgtccgttcacaccggacgacctcgaagacctgtatgcgtaccagagcctccccgaggtcgcccgctacctctttcggccgccgctgacccgtgaccagtgcgtgcagagtctggcgcggcgcgtggccggcacggcatgggccgaggacggtgatgatctggtggtagccgtctgccgcacaggcggggcaacggtggttggcgaggtcgtcctgaaactggcgagcgcgcgggcctgccaggctgaaatcggctggatcttcaaccccgcgtacggcggccggggttacgcgaccgaggcagcatccgcgaccgcctcgctggcctttgccgagctgggcgtccaccggctgttcgcccgactcgatgtgctcaatagcgggtcggtgcgtgtgtgcgaacgccttggcatgcgccgggaagcgcacctcgtcgagaacgatctcgacggcgagcggtggggcagcgagtacgtctatgcgacgctcgcccacgagtggaaggccgatcgggcctgatgctgtgaccggataggttcaccggctggcctcgtggcctgcgggtgtatgagtcaccgctgctcccgggttcggctggtcgcagggctcatcgacgttgttttgcgtggttgtaatcaacttgctgtcgccccggcggccgggcaaggtctggatcatgctcgggctgcgcaccttggaatcagacgactggcccctttggcgggagttgcgactggcagcgcttactgacgcgccctatgcgttcggatcgacgctggccgagtggcaaggctccggtgatcgagaggaacgctggcgtacccgtctgtcgatccctggcgcgcgggatctcgtcgcgctcctcgacggccttccggtgggcatggtcagcggagtgccgggcggggaagcagagaacgtggagttgatctcgttgtgggtcaaccccacggctcggggccaaggcgtgggtgactacctgatccaggcggtcgaacggtggggggcggagcgcggtgccaggacgctgcggttgtccgtgatgccggacaaccgcaaggcggtcgcgctctatgagcggcacggtttcacggacacgggtgagtccggcaatcttctgcccgccggcgttcgcagggagcgggtcttggcgaagagcctggccaccgtctgaatctccgcgccggcgcacggcgaggtctcctggttggtcaggctacggcggtgtgtgggcgtccgccccagcggatgcccttctcgccgcgacgcgggcgcgttccttgcgccggcgaccagacgtcggggtggcgggcgtgggcgttgcgccagcgcagatggcggtgcaactggcgggtctggacggtgtggtgggggtggttcgggtggggtggctcgggttggccagggtgaactgccgcagcggaccgaagcgcgcccgtccgttgtccgttgtccgttgtccgttgacgatccggcgctcagccggcgagtactggcatgcgtactgccgccggcccgcggcccaccgcaccccttcttcaggaaggcgctgactgcgtcgaactcgagcaggccgccgacggcgatcccggctgttgtacgcggcgtagagttgccccatggctcggcctcgacagtttgacgaagaagaggttgtgcgggctgcccgcgatcagttctggtctgtgggctacaacggcacctccatcgacgacctgagcgctgtaaccggcctgggtcggggaagtctgtatggagccttcgaggacaagcacgcgctgttcctgcgggctctggacagctacaacagcgacgcactgagagcctggcgcacagctctgggcggccccggaccggccctgcccatgctggagcggcatgtacgcaatgtcgcggacggcatcatcggggacgtggaacgccgcggctgcatgatggccaagatcgcggcggaactgtcggccgtcgacgagggcgtggccgagcgaatcgccgcggttgtccgcgggctgcacggcgcgctgcggggctgcatcacgcgggcccaagcggaaggctctctggatgctgatgcggacccagacagcctcgccagcctcctgcttgccgtgctccggggacttgaggccctgggcaaggcgggagccactcccgaggtcgtcaacggggctgctgagcaggccttggccctccttccccgtgtttcgccggacgagcatgcgccgggtaccaggtcctcgactggtgcctgacgtcgctacggcgccacaaaacggctgtcgccggcgcgccgccgacccagcgtcacagagaggggcacaggaacgaagcgccatacgggtgccagatccctggtatcgcgtgtctgcggacacgcgatgggatgtcactcgtcgccggccgccctcgcctcggcggcccgatcaggcgacgcggacaactcctccgcaccgaatgctgcacctgccaggccccggccaccctcggcagcctctgtcctgcctcgctgacaaccactggtggccctgaagtcgcacgacatgtgtggctcaggcatcaaacgcccggctttcgccggcagcttgtcggctgccggcaggactcctgtacgggcagcgccggctaccaggggcggacgaggacggtgccgatcttgccgggccgtaccgcgtgctccacggcgttgcccagctcgtcaaggccgtacgttgcggccacgtcgaactggtccttgagcgtgagcgcgatcagcttcgcggtggcgacgtcggatgcccgtctgtcggcggaggcctcggacagccaccggccgatgttcttgccccgtagcgtcagcgacttgtgcagcagcgtcgacgcatgcaccgagatcggctcctcgccgatctgcccgtagctgaccagcttcccgcccggcgtcaacaggtccagaaggctctccgccagcttcccgccgatcgggtccagggccacactgaccggacggccgccggcggcttcgcggacctcgtccgcccagccaggatgctctgtcgccacgaccggcacgtcggggaatcgcttgcgcagttcggcggcgccgcggtcgctgcggacgacgttgacgagcgccaggttgtgcaccagggacgcgcccgtcagcagccgcccgaccgacgagcccgcggcggtctgcacgagaagaccgtcgtatccgaaggccgggtgctcctgcgcctcacggcgcagcatcaccgtggtgagcgggttcaccagcatctgcgcggcgacctcgtccgacagctcgtccggtacggcgacgagcgcgtcggcatccgccacgatccactgggaccaggcccccggctgcgggaagaccgttacgcggccgccgaccgtgacgcccggcgccacccgtgttcccgggccgatcgcctccaccacgccggtggcctccaccccggcgggaaccggctttgtcgcctcctcggggtaggcctctacggcctggagatcaccagggtgcaccgggaaggcggtggtgcggatgaggacctgaccggacccgggcgccggctccggctcctcgatgacggtcaggacgttggccggcgacccgccacgggtgtagacgacacgacggttcatgatgctcctcctgcgcgctggagtgtgggagccggggcgtcagccgacgtcctgcagcagcaggtgctttgcactgagcgcaccgtccagctgcatcagccgcccgccgtcccgcagaccgccaaggtccagggcggcgaatccgaattcgtccagcaagccggccacggccgtcttcgcgtcggcgtcgtcgcccgcgtagaaggccacctgtcggccctcggcatgccgcgggtccgcggcgatgaacgtggcgaacagggtgttgagagccttcacgagccgggcgccgggaaggtggcgggcaacccactcgctgcccgtgaggtcaccgacgtcgtaccgtccccgccaggggttggccgccgcgaactgattcgtcgtgtcgacgacgatcttcccggcccaagtggtgaggcctgtcagttccggcacggcgaagaacggcaccgagaggaagacgagctccggctgcaccgcctcctcggccgttaccgcacgggccttcggccccagcctgcccacgagggcttcgagagtcctgggaccccggctgttgccgatgagtacctcatgaccgtggcggacggccttgtcggcgaccgcctgtcccacctctcctgcgccgagtacgccaatggtgccgtgtgtgctcatggtgctcttccttgatcgtgtgcagagaccgcgcgggctgcccggcattggctcgtgcagccgacccggcctgcagaggggaccgtgcgcctccgcctgtcaagtgatccaccgcctccacccttgctctcgccggtggcgggagtcttcggcgattccatttcctggggccttcggtgctgtgccgtgacgacgcctactcgcggtgcgggttgaagtccagcaggaccttgccgtttttctgcaggtacgcgagggcctcggcgaagtccttggcctggtggacgggggcggagggcaacgtgagctttcccgccgcgaccagccgcgccgactccgcgccgatgtccggatgacggggcaggtactcgtcctggtacatccagaactttgttgtggtgatgttcttcgccctcagcacgttacggtcgggcgtgaagggctcgccgctcatgtagccgtagatgagcagcagggcgccgtcggtcagcacgtccagcaggagcgaggtggcctttccactgacgccgtccaaccccagcagcacgggatcgtcgccgatggccgcacgcacgcgcacggccacgtctggggagtcgatcagcacgatgtcggcgccgagtgcctcgagttcggtgacgagctcctcgcggcgcacgatattgatcgtgcgaagcccgcgctccttggcgaaggcgatgacggaccgaccgaccccgctgttcgccgcgttctgcaccacccaagagccggccggaaggtcacgcgactccaccagcaggcctgcggtagtggggttgatggtgagcatcgccgcctgttcgaggctgatggcccggtccacggcggtcagcttcgcggcctccgccaggacctgttcggaccaggcgaaggtgccgaagggaagcaggaccgtatcgccggggcggatgcgggtgacgcccggtccgaccgccaggaccgtgccggctccctcgttgccgatgacactcggcagttcggggcggaccggatagacgcccctcgccaggagcaggtcgtggtggtcgagcggggcgtactcaacctggatcagcgcctgcccggcggcaggagccggaggctcgggaacgtccacgaccttcagactctgctccggctcgccgaactgcgtgaggtgaatggcgagcatggaactcatctccttgcagtaagtgcggacgcagaacgaggcgcgaggcgtcctcggctccgcgccgcaggcccttgccgttggagagtcccggggcgcgggtccgcatcgggcccctgaagtgaccgcccagtgctcggagccaaagccgagggagcgagcacggcagccgcggcgaaaccgagcaccacgtgccacgcatgctggagcagagccaggccggccaccccggaggcgttgccgaacaggcgacgagcatgcgggctgcccagcaccggctcgtccagcgaccggcggcgtgttcaacctgccgagtgctgcaaggcagtctgcgcgcctccgcccctcaaatgatccacagccatccggtgacactctcggcaacgggagtcacagcacttccgccccgaggaactgctacacatatccggttttgtacctaccagtaaataactcggatccggagtacgcaaccgcggatccttgtgacgagccgccggctctccgagcatcgcgaagacctgttcgacatagtctcgcctgggaatatctctcacctctccggccggccccggagcgaggtcacatcacggcgtcggtctgaagcgggcccgcagtgatgcggagcgtccggatacggaccggctcttcccggtcgaggtagaagatgtgcgtgaacggggcgcgcaccaccttgtccggttcgctcttcctggccatggtcgcctcgccgcgcagcaggcggacgccgtcgtccgcggtccagaactccaagacctcatgggtgatgatcagcggcgcgtcgatcttgacgaagaacgctttgatggcctcggcgccgtggatgtgcgcggtgccgaagaacatgtcggtgttctcggtcaggggcgcgaagccctcaccgaactccagggtgtcgatggcgtccatgaacttcaggacccagctgggcacggccgtcgcttgtgcggtgtcgtctgtcatggtggtggccttccgatcaggctgcggcaggcagggcggcaaggaaggcgtcgatctcggcgttgacaccttcggggttcgtgcgggcggcgaggtgggcggtgtgctggagcagccgcaaggtactgccctcgatggcgtcggtcatcttccgcaccacgtgcacggggaactggctgtcctcctcgccggcggtgttcaggacgggcatgtccctcatgctgttcaggcggcggcgctcgtccttgcggccgatgaggatgccgcgcagcgcccacgcgaccgacttgccagtgcgtggccatggtcagtcctctccgcgacccccggggagacgttcgggattcctagcagcgtcccagtagcgtaacgctactagtttcaaatcgctactacgccgtgcctcaggccgaagcggtcaacggcgtcccgaaccggggtcgcccggcgccgcggaggccgctcccctcccgcccgtcccctggtcaccgccctcctcggcggacaccggccgcagcgtcgaggcctccaccggctggtgacagctgctgcacgcgagatacggattggtcgggttgccgcacactgtgtgcatcagtgggtgatgtgtgatgtcaccgccggtcgcatgggtctcggcccaacgcgtgatggccgcgatggcgggaacgacgagttcgcgggcgctgtcggtgagctcgtactcgtaccacggcttgtccgagcggtaggcgcgcttggtgagcaggcccagctcggtcaggctgttgagccgcgcagtgaggatgttcgccgagatgcccagggctcgcttgatttcgccgaaccggccgacaccgaagaacacctcccgcaggatctggtagttccagcgctcggagatcgcggccaggaactcctgcccgtgctggaaggtgacgtgactcctgcggtcggacacggcttctcctagttttgaatcagaagtagttctgaaacgttactagtaacccttgtccggggcagccacgcctgaggggtcgcgaagacaggcgagagccggtaggcgtccccgtgcgtgatcacgcggccggcggtgggatgcgggaagtgggtgcccagcaccagggtgtcggtgtcggcgagcgagccgagcagcttgcggcgcgaggcctcggaccgctccgggtggatgtcgacgcaagagccgatggaggggtgggcgagctggaccgggtgatggatgcagtctccggtgatcagcgccgtctctctttggtgaggaaaaggcccaatggtgggaccgcgcggacgccccctacccggacttcgtcgaccaccgcgccgggaccgaccgcaacatcgcgctctacatcctcgaaccgggggtgccgtccacgatgagcaccgtgtccttcgcgaagcggcgccggggttgtagtgctggcagcggaccgaggtgcttcatgatgcggtcgaccgcggacttcgagatgccgcacagcagggcgagctggcggatcgtcaagttcgtgctccagtacgccgtgaccatcagcatgcggtcgtccagtgacaactccagggccggcctcggtggacagtatcgacgcccgcgcgacgcagtaccgtcaccggttcgcgaactggcggggactcagcccggtgaacggggctgtccaagacggctccgacgccgtgatcacaccagtcacagcgagatcattccactgccgctgatcccctcggctcgtgagggcgggttccggaagtgacggcgaggatgtcgcggatcgcttcgcgcaggcttccgaagtggcggtgcacgccgtccaccgcgacgggtgcgttgaccccccacaccgtcatcccggcacgcagtgcggaccgcacaccggagggtgcgtcctcgatgaccagacagtcctgcgggtcggcaccgagccgcttggcagccagtagataagggacaggcgagggcttgccctcctcgacggaggcggcatcaacgatgatgctcgggaccggcaagccggtccgggcgaagcggccgcgcacccggtgctcgtaattcgacgtcaccagcgcccaagactccggcggcagagcgtccagcagctcggaagcaccgtcgaaggccgcatacacgccggaccggacgtcctcgtcctcgagttcatgcagcgcggccaggcactcctgcgggtcacggtccggagcgacctgcgcgaaggtctccatcggccttgtccgcaaggccacttggtagacctcaccggggtcgagtccgtatcgctccgcccacaccctccaaacccggcgctggttgtccacagcatcgatcaacgtgccatcgacatcgaacaggacatacttcttggctccaggctgagcaggttcaccaatcacaccctgatcctgccatcaggccccgagcaggcagtctgcgggacagccgggcaagtcgatggagcggccgcgcgccttgctgagcctaggtccaggcggtccacttgtgccatcgggtctgactcctacgtgaagtcacacctgatgcatggcactcctcacaccaccggcgatcagtcttgctcgtcacactggatgcggtcgcggaactatcgcgtgggtcgggtccatccagggtccctgccggtcacggccagtgcccggtcggacaggggctcatcggccccttgcggcacctcaccggcggttccccctcgaggccatcgcgtaggcccaccgctacctggaagccggcggccaggtcggcaagatcgtcatctcggtcacgcccgaggccggaacgtcctcgtgacgttcgacgctttcccaagagaggtaacccggcaactagaaactcgttccagtcggcagcacggcatgcgcgatgccggtgaggttgccctgcgcgacgaggatctccctgcggttcgatccgtcgagaccggccgcgtagacgttcccggcgaggtcggtcacgtacatgcggccgccgtccggatcgagggcgatgccgatggcttccatcaggtgggtcaagaggatctcgggtgtccgctgcgcgtccggcgggtgcatcggcgagcggttcacgctgttgccccgcggcgggtccccgcgatccgtccagtagagcatgcgctccgcgaggtcgagctccaggtcgatcggctccggcagcccctcgaacagcacctcgatgtcgccgcgttcggccgcgctttccccggcgggcaggctgattccggcccgcaggatctttccgagtcccgcgtcactggggcccttctgtgtccagtagaggtgtccgccggccgggtcgacggcgactcccacacaccacctggtctcgtcgcggcggtcatcctctccctgccccgtctgcacgagggtctcgacgtgcgagccgtcgaggtcgcagcgcatcacgcgcatcccctcgcgatcgccccagtacagcttccggccgacggcttcgagatacagctgcttcggcgtgtgcgtgacgccgctcgggacgatcgttgtccggttgcctccgtccaggtccacgcgttcgatcgagccgtcgttctccggcggaaggcccatgttcgtccagtagacgtgcccggccaggacatcgatggcgaccccgtcggggatcctgcacccggtgacgatgaccttcttgtcggagccgtcggggttcacggagaacaagcgaccgccactgctggcctcgagcacgaacagtctttcctggcgttgcgtcacgcttcctccttcggcccgcgaccggctgtggcgctcgggccggacgggtcgtgctgggcgcgcacggccagcagggccgagagcatcgcgtcgcgccgggcggccagttcatcgaccgagcggccgcccgcctcctccaggacgccgcccacgatctcctccttgagctcgggcgtgaactcggggatgcccagttcctgccaggacgccaccatccgcggcatgagggtgtccatgaagtgctggatgccgccctctcctccgccgagatgccacagcagatggggacccatgaccccccatctgagccccggcccccaggacaccgcgtcgtcggagtccgccacgtcgagcactccctcttggaccaggtacacgacctcgcggtacagcgcggcctggatgcggttggcgacgtgcccgggaagctccttcttgaggtgaatcggtttcttgccgatcgcggcgtagaacgacatgacgtcccggatcgtctccggggcggtcctcgtcccgccgacgacctcgaccagcgggacgatgtgcggcgggttgaaaggatgaccgatgacggtccgctccggacgtcggcactcggcctggatgacgctcatcgtgatgcccgacgaactcgacgcgatgatcgcgtccggcggggtggcgtcgtcgatgtcggcgaacaacttgaccttgagttccgggcgctccggcgcgttctcctgtacgaaatcggcgtccgcgacggcctgacgcaggtccgcggtgaagctcaggcggtcgggcgaggcttcgggcgcgagtccgatcgaggcagccgcgtcccatgccgcctccacgtacgaacgcagggccgtctccgcggtggggccggggtcggtcgccgtgacgtcgaagcctcggacgagatagtgcgtcgcccagctcgcaccgatcgtgccggtgcccacgatcgccacgcggtggacgggtgtgtgtacgttcatgactggtcactgctcctgaaactcggacacgggctgcgggggaagagcggctgcggcggccggtatcagcggccgtgccagaccggggcgcgtttctcggcgaacgcctgtgcgccttcccgcgcgtcctcgctggcggccagtccgctcgtgagctcgtcctggcgtctgaacgcgtcgctctccttcaggccctgtgtctcgcgcaggacctccttgacggccgccagtgcaagcggtgcgttccgcgcgacgcggcccgcgagctcccgggccgcgtccagcgcggcgccgggcggggtcagctcattgacgagcccgtactccttggcttcgacggcggtcagcggctcgcccgtcagcagtacgcgcgcggcgacgtggtacggaagtcggcgcggcagcctgaccagtccgccctccgccgccacgagaccacgcatgacctcgggaaacccgaagcgggcgtcctccgcggcgacgatcaggtcgcaggcgaggaccagctcgaagccaccgccgagcgcccagccctcgaccgcggcgaccagcggctttcgcaccgacgcgcgggtgagcccgcccaggccccggctgggcagcaagggcagctcgcccttggcgaacgccttcaggtccatgcccgcgctgaacaccccgcccgcgcccgtgaggacgccgaccgacagctccgggtccgcgtcgagcagatccacggccgccgcgagctgtaccgcggcctcgtggtcgacggcgttcttctgcgcggggcggttgatggtgatggtcagtacgccgccgtgacgctcgtggagcaccaagtcggcagcttcgggcgccgtgctcatcgcggcccctcggcttccgtcgggccgggaatcgctccctgggcgcgcagctcggcgatctcggcggggccgaatcccaactcggcgaggatctcgtcgttgtgctcgcccaggtccggcgctcgcttcgccggcaccttcggcacccctcggatgttgaccgggctgctgatggtttccgccagcccgctgactccttccagcggcacgacgatgtcgttcgcgcgcagctgcgggtcctgcgcggcctcctccggcgtctggatgaggctgtacgtgacgcgttcccgggtcagggcgtcccgccagtgggcgaagggctgcgagcggaactcggcgtcgagcagttcgctcagcgcggcggcgttctcgacgaagccctcgatgtccgcgaaacggggatcctcgagcagctcggggtgcccgatggcccgcgtcagtcccggccagtgcgggggtgaggcgaccagcatgaaccactcgtcgtccgcggtccggtaggggttgatcagcgggttcgccggcgccttccggtcgtgcagctcgaacggtgtgccgccggcgagtgcgccggccacaagcgttcccgtggcccagacgcccccggcgagcagcgacgtcccgacactggccccttgtcccgtccgctcacggcggtacagggcggtcacgaccgccgcgtagatcgcgatcgccgacatgtagtcgccgctgccccagaccgggaccgtcggcggggccccggcgtcccgggtggaggccagcagcccgctgcgcgaccaggcggcggtcaggtcgaagcccggctgcccggcgtcgggaccggcgtcgccgaagcccgtgatgtcggcgtagacgacccgcgggttccagcccgcgacctcctcgtagccgaggtgcagcttctcgcgcgtgccgtgcgggaagttggtgatcaccacgtcggcccaatcgacgaggcgtttgagtacctcggtggccgccggtgacttcagatcgatcaccatgccgcgcttgttgcggttggcgaggtgccagctgtagttggcctgtgcccgggggctgggcgggaccgagctcagccgccgttgggggtcgccccttcccggcggctcgatcttgatgacgtccgctccgaagtcggagagcacggtggccgcggccggtcccgcgatgaagctcgacacgtcgaggaccttcaggccggtgaagacggattcgttggtcattgtcgtcacctcacgaaggcgctgaggccgccggtcacggcgcgtccgacgatgagggtctggatctcccgggtgccttcgtacgagtagatggcctcggcgtcggcgacgaagcggccgaccttgtagtcgaggaggatgccgttgccggccagcagttcccgcgcccaccccacgttctcgcgcatccgcacggtgcagtaggccttcgccagggcggactgttcatcccggaacaccccggcgtcctgcaactgggccaggcgcgtcatcatcccgcacgaggccgtggcgttgccgagcatcttcacgagcaggtcctgcacgagctggaagcccccgatggggcgcccgaactgttcccgttccttcgtgtactgcagggcgatctcgtaggcggcgaacatcacgcccaccgcctgccacgccacgccgctgcgtgtctggcgcaggatcttggcggtgtccttgaacgagtgcgcgttctgcagccggttggcctccggaacgcggcagccgtcgagcacgatgtcggcgttctgcacgatccgcagcgccatcttgttctcgatcttcgtcgcggtgaacccgggagtgtccttctccacgacgaagcccagcacatgacgggtctcgacatcgcgggcccagatgacgaccaggtcggcgaaggtcgcgttgccgatccaccgcttcgcgccgtcgaggatccatgtgtcgccgtcgcggcgcgcggttgtctggaggccgccggccacgtcggagccaccgtgcggttcggtcagcccgaaggcgccgatcttctcgaagcggctcatcgccggcagccaccgccgcttctgttcgtcggagccgcaggtgaggatggtgcccatggccagacccgtgtgcacgccggcgaacgtggccacggacgcgtcgacatgcgccaactccagcgcgaggaagcccgcgaggaggttgctcggcctggattccggggagtccgggtcggcccagtccataagaccgagcctcccgaagccctcgaccaactggaaggggaactcggccctggcccagtaatcatcgacgatcggtgcgacctgcgtgcggaggaactcgcggacggactcgagctgctctcgctccccgtccgacagcagttcctcgtaggcgaagaagtcggcgggcagcagccccttgtccaggtagggaccggacggtgccggcaaggtcgttgtaccgctcactgcagtctccctcaagcgctgtgggggcgtgcccagagacccgcgcccgtcagagcttccgggcctggcgtttcagtactctggcccgattagacgcggatcccgggccgatccacccggacccgcgccgcgcagcgatgctgttgtcgccacggatcactccagtggcccgtcgccgcccggtgcgggagaggtgaggcaggactgcgaggtgcccgggacggacgcgggcaagcctgccggtgagcgggaggtctaccgggtactggaggaagtccacaccctggccgggtgccgcatgcgggatccagtgcatcgggtgcgcgggatcctggtccactccaccgccgtcgcggcgggcccgcggacgggggctgccgagccgggccatgtcctggccggccgtgcgtactcctcccggaagatccgcgagtacctgcgcgagcggcagatcccgcacgcctacccggagaagcctgaccgggccggacaccgcctccccgcggctcggccggatgacgtccgcccggattcgaccatgggtgatctccttcgaggctggttgccgcctcgtgctcgcgccccgccgggtgggtgatgccgcccggcgcggaccacgaggtactacaggcgggcggcgaacgcgctgatgtgggaggcgacctggtcgggcacctccagtggcgacaggtggccggtaccgtcgagttcggtgagggtggcagtggtgatcagaggaagcaggtggtcccgcaggatctgcggcgggtccaccttgtcgtcgctgccggccagcaccaggacggggacgtcgatcgcaccgacccggtccgtgaagtcctcgaccagcgcctgtcgcggccacgccatgcgcgccgcctcgcctgcccgggaactgtcctcgtgaacctgccggcgcacctcggcggacagctcgccgttggtcagtacgagatcgatgctttggtcgatgggtctcgccgttgtcgtaggcgtgcgccagcgtctcctggaactcgtgtgtcacaccgaacggagccggcggggcgggtgcgacgagcactacgcccttcagtccggcggggcggcgagaggcgagcgcctgagccacctttccgctcatcgagtggcccaccacgacgtattcgccgtggccgagttcgtcgatgacgcgctcggcgtcgtcggcgagctgctcgatgccgtaggggccaggaacctgggtggactcaccccagccgcggtggtcgtacgagacgaacgcccgcgcggggctgaggagttcgatgaccggtcgccaggtgcggtgggagccaccccagtagtggaggaagaccagggtcggcccgtcgccctcgcggacgtggccgtagatccgcccgtccttcacgttgaagtaccggccgatcggggtgtaggtggtcacggtgtcgtgttccttacttgggccggtgctgagccgctgtgctgcggccgctgtcggcgtgagcctcggcggtgggccatgctgcgcatggctccatcgtcgtccggcccttctcgatcaaccacaagctcgtatgccacccttcgcaattttcgggacacacaagcggacggtcactcgctgaccgacagagccgcgccgctgccctcggtgaccacggccgatggctgcgatcacgccggcgccatcccccccactgctgcgctgatacggctgctcgggttgctggggcatgggaacgctccgggcacaccgttcaccctgcccgtccgagccgcacagccgacgcattcaccggccatgggccgccagacattcctgcggttcccgggcagcctgtccagaaagttacggtcgtagccttggagccatggctccccatcgcgtcgcggtcctggtgctgcccctggtgctccccatcgatctcggcatccctacgcagatcttcaacgcgcggcccaacaccccgtacgaactcacggtgtgcggcggagcccgtggcagcatcacgaccagcaccgggttcacggtcggagacacagcaggactgcctgctttggccagggcggacatgatcatcgtgcccggctactgggaatatcagcggccaccggcacccgaggtcacggcagctctgaaacttgtcttcagccgaggcgcccgcatcgcctccatctgcaccggcgccttcgcactggccgcggccgggctgctcaacggccgtacggtcaccacgcactgggccagcgccgacgaactcgaaatgctctacccccaggtccgggtggaccgcagcgtcctctacatcgacgacgatcccctgctgacctccgcgggcgtgaccgccggcatcgagctgtgtctccatatcgtccgcaaggacctcggcgctgccgacgccaacgacatcgcccgcgaactgttcgccgcaccgcgacggcggccaggcccagtacatcacccagcccctgcccgaacccaccgctcacaccctcgccgacacccgcgactgggccctgagtcacctcgacgaaacccctcacactggaggttcttgcccggtacgctcgcgtctccgcccgcaccctggtccgcatgtggcgccaggaaaccggcatcaccccacaccagtggctgctcaccgcacgcatcaaccacgcccgcgaactcctggaagtcaccgacctcggcatcgaacagatcgccgcccaaagcggcctcggaaccagcaccaacctccgtgctcgattccgcgacaccctcggcaccacaccttccgcctaccggcggaccttccaggaaacaaccatggcggggccccaaacccgccagaagtgaaacccaagaacctgcgcgccgaggtgagacaggtcgaccgtggcggcggctcggatgtcccgaaaggacgtcgaggacaccatggcgttcagcgccctgcacggcatccgccccatgaccgaaatcgtgccactggaccgcgcggacgaggcctaccagaagatgctcgccggcaaggcccgcttccggatggtgctcacggccggctgacacccatcagccggtgccgctctccagtcacaccccgcctcggccaagtccctcacttccgatccgaggccacccggccgaggcggattccggcagcgcctgccctggtccggttgttgcgggcttcgtcctgctggccgtgggatccgcgggcccccgcctccagaaggctgcgctcgtgccggcagccgcggacctgggttgagcaagacgcgcatggggtctgcgagggcgcgaggttggatgcgagccgggatggcagcaccgcctcaaaggcttaacgcaaaatcaggaaggccgtcgaagaactgatcgccgaacggggcagcgacaagccctcgggctcgtggtggcatctcgtcttctccggaccatggaaacgatcaagggtgagggcttgttgtgcctgagcgtcccagttggcaattgcgcgctccggttggccaacgtgacgctcagcggcgcggtgcggcgatgggccggcaccgcgtcggcgggatgtcggccgtccggcgggactgtcggtgatccataggcgatgtgtcggtggccgccggaaccatgggggtcgagttgcccaagggagcagccgcagccgccttccacagcaagggacccccgtcaccatgtcatccacttcctccaccccgccatggaatgtccaacggctgcccggtgccgatggccgcgtcttcctggtcaccggcggcaacgccggcatcgggtacttcgtcgcggagcagttgtcggcaaccggagccaccgtcgtactcggcagccgaaatccggccaaggccgaggccgccacggcctcgatccgtgcgcgtgtccccggttcgcgggtgcgggccgtacggctggacctcgccgacctctcgtcgctcgaaacagcggtggaatcgctggaggtggagcgtcttgacgcggtagtccacaacgccggcgtcgcgcttgacgaccctccgcgcgaggagaccggggacggtcacgagctcatgttcggcacgaaccacctcgggcacttcgccttgacccagtggctgatgccgctgctgtcggctgcgccggctgcccgcgtcgtgaccatgggcagcttcgcggcaaagtccgagcggctcgacctggacgacctgcagtcccggaaggactaccagcccaagcgcacctacgggcgctccaagttggcacagatgtacttcggcgtcgaactcgaccgccgcctgcgtgctgccggcagcacggtggcgagcgtggtggtccatcccggcggcgcgctggactccctcaccccgtcgcggccaccggtccatgtgcgaagtaccggcgcccggctgagcgcggcacctgcggccctcctcctccagggcaagcacgccggcgcatggcccgcggtccgagcggtgctcgacccggccgtgcgtggaggccagctgtggggaccgcgcgtcttcggcctgcgcggcgagccccgacgtgaaccggtgtgggaccacctcgcggacccctccgtcgcggcgcggttgtgggacgcgagctgcgatctgatgggcaccgacctcagcaccatctccggatagctcaggcacgcgcgcgttggccaacaggttggcgagcagttcctgggcacctggggtgtgcagcacgacggtctggacgcgtgggtggaaggcgtcgaggtcgaggatgtcgcgggcggctgccgggtcgtgcaggcggtcgcggacgtcttcgacccggacggccgtgggcggtggcccgtcgttgaggtgcaggcagccgaacgagatcaggcgggctccacgctctccccgcctcatcgcccaggaaggtcgccatccgcttgccgagcagcgtctggcccggcttgttccaccgcgtgtcgcgcgagccgagcgcgtcgatcacggcgaggtcgccaccctcgtcgcgggcgaaggctcgggtgggcagcgcggccttgcccaccgggttggcggcgaccacctcgtcggtgttggccggcgtcccgtccggcgtcacgatcacctgtcccgtgagcgtgaccgcgtcgcccgccgggtacggcacgcgcatggtctccaccacgccgctgagcatgacggcgaagccgactgccgcgatcaccggagcggtgagggaggccgcccggcgcgagttggcgcgcaactccgcccgcacgcgcgtctggacatccccgaggtttctccgctcgtcgcccagctcaccgcggccgaggagcagctctccgctgcccaccaggagctgcgcagtctcatccgggggctcaacccgccggtgctcgcagaccacggcctggtcgccgccgttcaggaccacgcgagccgcttccccatcccggtcaccgtcgatctccagttgccgggaagacttgcccggcaactcgagcagaacctctggtgcgactcggccggccagatcaccgacagctcaaggacggttcttatccgaaggacgccagaagttcgcgctctctgtccggggcgagtcccgcgcggcgtggccggtgcagtccctgctcgcgttcccagcgcagtgtgtcggcgaggaggccggtgcgggagcggtggcgcaggcccgcggcagtggcggcggatccgtcgcgcgccgcccagccctcccaccccggttcgaccacccacatgggcagtgagtcgggtcccatgtactgggccactccgtgcgcgaggagctgctgggacggcacggtgatgaccgctccggtgtgtccgccgacgctgcgggacagctcgatccactcggcgaagggcacagccgggccaagcgcgttgtaggtgcctgtggttcggtgttctgcgatgtcgaggagccatgtcgccaggtcgcgcacgtcgatggtctgcgtcggggcgttcggggtgtcggggacgagcagcggcgcgtggggggctcgggcggcgcgggcgacccagtagccggagcggtcgctgtggtcgccgggcccgccgatgagtccggcgcgcgcgatcaggaggcggtcggccagggccgtccgggtgagcgtttcgcaggcggacttggcctcgccgtaccggtcacggtcgacctcttcgcggtctgtggcgggcagcagggcggcggactcgtcagcaccgggctcaccgtgggaggcgtatgcgctgaccgaggagacgtaaatccagtgacgtgcccgtgcgcccagggccgcaactgctttccgtacgaaaccgggttgccaggaaacttcaagcacagcgtcccattcccggccgggcagggacgcgtacgcggcggggtctcgccggtctgcggccaccaggcgcgcgccttccgccacgggaccgctgtcgccacgggccaggcacgtcacgcggtggccccggtcgagggcctgccgggacacttcacgccccagccaggccgtaccgccgaggaccaggatctccatgcgctccatggcggaactcaatcagcacggcccgatcacgccaagaggcttctgccgagggcagagcccgcgtctggcgttgcatccccatcctccagccgtcagctgcgagcactgcctgctggtccggcaccacatcgcaactccccgcagctgcggcaggaccggttcctggacgaggcacgagagaccgcgggcccgatccggctgatgcgtttgttcggcagcgtctcgcgcaccgcgatccactacgtccgcgcggcggcccaccccgaatgcctcaccatcgaccccacccaggtgtgagccttactgacgccgctggccaaggacacagaactcgttgccttcggggtctgccaatacaacccacgattgatcaccctggccgatatcgacacgctgtgcgccatgagccaccagacgagccacctcggcgtcctggtcgtcaggcctgaagtcgagatgcagtcggctcttggccttcttgctctcatcaatccggacgaagtccaaccccggcaggcgatccggctccgggcggatctcgaactcgtcatcggaggagtggaccactacccaaccaagagcctcggcccaccactgtcccagggctgccggatctaccgagtgaacaattacctgttcccattccaaggtcatccgcagagcttagacctaccggggcttcgaaaaacagggcactcaggcctccctcatcgggctgaacccgggcacttttcccccgcggaacaaccgccacccacaggctcggcacacaccagcgttcagattccgcgaacccggtggtttcggagtacgaccgctgcgccgcctccgaagtgcttgtcacccggtgtcagttacggtagctgaatctcggcccgggcggtcacgaccccgtcgcggtcctgcgttgcacgtggtgcctaccggccccgctggtcgtgcatccatcccacccgggcttggctgtaccgcgtcggtctggcgaagcccaagcgtgtgccggcgctcgctcaggagcgggcgctggaccgggttatggccgccgggccgacccgcctcgcttgcggccggcgctttcacagctgtctgccgctcaaaaagttcggctcccgccttctccggagcaacgccgcgaagcattccggcagatgtcaggcgttccaccattcgtcggtgccacagccgacctcgtagtgccaccatccttcgtctcgcccccgcttcaggagggccttgatcccggcgaagtccgcgcctgccggtgcggtgaaagccaccatggggaagtcctcgctgaagacctcgcctccgagcccgaacgccgaaaggcgctgacgcaccgcctgcggcctacgtccgaggggaccggtgggcacgggcaccacacggatcgtgcagttgccggaggaactgacccggtggacagcccagtggagcccgtcggagtcggttcggtaccgcactacatcgccctcggcgatcccgtcctgaaggaagggagcgttctgcacactcgccgtctcgtcgccgagtttcgtcgcccacaggccctcggtgtcctgcgggaaccacccctcgcgagggatgaaccggaagcggaccttgatcttctcgaccacgttctccatgacggccatcatgcgccgatcgtcaatgacgcctcgcaccaggtctgagctggagcccataacatccggactcttatggtgcggccgcagtggcggtgcgagcaacgatctctcgagaggtcgggacacccagattgacggctccctgcttccgggcgatctgcgcgtcgagttgggcgatcgtttcgtcggcgtgggtgaggctgctctgcaatccttcgatctcgccgagccagccctcgcgttcggcttccagaatccgtgcgaggaggtcgtcgcggatctcgacgagccgcggacgctccgtcgcgtgaacgatcaggacggagcaccccacgcaggcttctctgaactaccgcactcgaccttcggtgctggtgtcagcgcctcgctcggatcttgttgccgcctggtcgtggctgtcccggtgcctcggtcagatcatgtggttgggcttccgggtgtgcggagggttcggcggatggcgttgcgcagccagtggtgggctccgtcggctgtgtgtcgggggtgccaggccatgccgatggtcagtggaggcagttccagggggatgtcgaggagaaacagtccgagggcgatggcgtcgtcggtgaggggggagggggcggcgccggggggtgcggcaggtacgaggcagacgacgtcgctgcgggtggcgagggtcattgcggccaggtggctggggaggacgaagctgacccggcggtggaggttctgctccgccagggcggtgtcgagggggccgctgaaccggccgcggcggctgaccgcgacgtgctcggcggcggcgagccgggccggggtcaggggtccttcggtgagggggtggccgggccggacggccgccatcatgcggaggctgaccagttcttcgacctgggtttcggggtccacgtggtcgatggatccgatctccaggtctatccggccgtcgcgcagggcggttccggcctccagttcctcggcccggagccggaacgagacccccggcgcttcctgctgggccaggtgcagcagtccaggcgccagtgccgcgccgaccaggtcggcggcttggagggtgaaggtgctgcgcaggtcggcggggtcgacgcctgtgcctgggctgagcagtgctccgaggctgcgtaccaccgcggcggcttcgtcgcgcagggactgggcgcgtggggtggggaccatggcctgtccggcccggaccaggagggggtcctggaggatgcgacggaggcgggcgagggtgcggctcatggcggcgggcgaggtgtgcaggcgggcggcggcgcgggtgacgctgtgctcggccaggagggcgtccagcgcgatggcgagattggcgtcgatgaccggctctgggctgttcaccagcatcattccatttcagtcaatgattccgtgctgaagttcccattgtggcaacacggttgccctccgcaggatgagggtcgtaccgatccggcacgacctgcgaggctttcatgatcgttattaccgctcccaccgggaacatcggccgtcacctgctttccaggctcctggagtccgcccccgccgcgggtgaggaactgcgcgtgatcgtgcgcgaccccgcccggcttccggacgcggcgcgcggacgtgtcgaggtgatcaccggctcgcacgcagacaccgaggtcctcgaccgggccttcgagggtgcggacgccgtcttctggctcgtccccccggacgcctccctggccccgcacgacgcctacagcggcttcacccgccccgccgtgaaggcgctcgccgtccacggtgtcggccatgtcgtcggggtctcggcgctcggccgcggcaccccggtcgccgaccgcgccggcctggtcaccgcctccctcgccatggacgacctcatcgccggtaccggtgttgcctaccgggccctggccaacccgtccttcttcgagaacctcctggaggagtccgactcgatccgcgacaagggcgtcttcaccgacaccgtcgacgccgaccgcaaggcccccctcgtcgctgtcgccgacatcgcggccgccgccgccggcctgctgctggaccgctcgtggaccggcaccggcagcgtcccggtcctcgggccggaggacctgtcccccaacgacctggcccgcatcatgaccgcacagctcggccgccccgtccgctacgaacgccagccgctcgacgagctgtacaccaccctcgtcggctacggcctcaacgaggcattcgtccagggcgtcgccgacatgaagcgagccaaggacgagggcctcgacgccggtgtcgcccgcaccccggacaccgcctcccccaccggcttcgagcagtggtgcgcccagaccctcaagcccgccgtcctctcctgagggcccaccacccgtcgccggaacacatggtgcccagcgcaccaagaccacctacacctttggagacgtcctgatgcccactgaggaaaccgaaccgccggtcacggcgttcatgctcgtcaagaccacacccgagtggctcgccctgaccgtccaggaacgtgtggacgccttcaccacccaggtcctgcccgcgatcgaggccaggaccagcggcgtcaggtcacgcttctacgacacggagttctactccgctcgcgtcaccgacgtctgggtgtgggaagcggaagaccaccacgcctaccagctcctcatcgacgcactgcgcgaaaccccgttctgggaccgctacttcgaggtcgtcgacctcctcgtcggcaccgagaacggctacgcccgcacctacggcctcgaacccgtcgccaccatcaccacctgacacgccgcccacaccgaccgcgcgactgatccgatgtcctcctgccacaaccggccatggacatcggaccaggaagaacgagagatatcggctgtccggacaggcgccgtagtcgtgctcgatgcgccggcggaccttggccagtcggatcagctcagagatggccgtgtcggtcggcaggttggacaaccagtactcggtgggtgcctcggcgccgtcgggccattcgatcagcagccggcagtccggcaggatcccgtcccaccagccttgttctgccgatgccgtggctttgatcgggcgctcgacggctttgccggccgtacggacgtatggcggcgaagcgggaacgtaactctcctcgtgagccctggcgccaggcgagggtggtgaagccgttcgctcgggtcccgccaaacacggcctgggcctgcaccacttcgaaggccgttcctggtccggctggcatcaccacatcaccctggcgaccgccctcccacgccttcctcaccgaacagcgcctgtccccaaatgtccccggaccagcctcaccctttaccaagtcctcgacaccctccagaacaccctgaggtgctggacaggcaacggagctgactcggctcaggcggtggcggccagcggggcagtggcttcccagacgaacccgtccgggtcgctgaacgggccggcggcgctggagagcacgagccggtgcgatccggtgccgtcggcggggacacccgcgtccttggcgagagcacggcgcttgtacagggccaacttgacggggcccgacccggtggcgaactcgacgtacttgccgccgaagctcttgcccacggtgaggccctgctcgacgtagaactgcttgctggccttcacgtcctcgacgcccagcaggagcacgagctcgtcgaagtcccgggtgaccgggccagtgtccttcttcgtcgacgtcgcgatcttccagatcgtgccgtccggggcctgaacggtgccgccgtagccccacagcgacttcgaggcgggcttgagggcggtggcgccggcgtcgagggccgcaccgacgagggcgtcgacgttgcccggctgggacaccacgagcgacagcgtgaaaccacggaaaccggtggtgggggcctcggaggcgcgcaggcgcacgtgcgacgagtccagtccgaaggcggtggagtagaagcgggcggcggccgtggtgtcggccacctcaagggtgacggaggcgatggagttcatgtcttcgacgataggggcggccgggtcaccgatgcttctccaaaactgcccagttcggccgcggccccgagccacgggcccgagcggccttccgaccgccgcgggaacccacctggacggcggccggtagctgcaccacaccgtcaccagcgaccccgactaccgtcgacgtcctcacgctgatcgtgccctgcgcccgcgagcgcggctgcgtcggccggcaactggaggacgagcgtgacctgctggagctcctcgcggacctgcactgtggcttgctgacgacgctggggtggggtttacccccgtgcgggtgggccagtcagccggataccgggccaggaccgttgcgaagatcatgagttccgaagctgacaagacggacaggaaggagcgaccgtgctcagcaggaactcaccggtcgaagaagccagggcgcccaggtggcgagcaaggagcaggcgcgccacggccgttgttctgctcgccctggtggccggcacggagctggctgccggccctgtcgctgccgcgccgcatgcagccgaccgcgtggatggcgtgtggcgcttggacggctacggcaccgtgctgtccgtcgaggacgggcggctgcgggaataccagacgaccgccgtcagctgcctgcgcggcgacaccgcacggcgcacaggccaggccggcaactcggtgatctataccggcgacgacacgaccgtctaccggatacgccccgcagcgggcaaagccggcgcgaccctgcacttcgacggctcggtcggcgaccgccggctgcggcgccttccggcactgcctgccagatgcaccgaggctgcaccgacgggagcgctggcgaccttcgacgtcttctggcagaccttcgaggaaaactatcccttcttcgcagccaagaagaccaactggcagacagtcagggaccgataccgtccaagggtctacgacgggatgccggacaccgagcttttcgcccttctgcgggagatggtgctgccgctgtacgacgcgcatgtgggtatcgacgccggtgacaccgggagcttcgcgcagagccgccccggcactatgccccccggccccggactcgaccagcaggcccagcgcttcgtcgagcagcacgacctcgccggcatgcggctgcggaccttcgcgaacggccgtatcgggtacgcccggttgccggacggaaccggctacctgcgggtctccggcttcggcggatacgacggcgacagccctgcctacgcgcgcaacagcgccgtcctggatgagacgctgagccaggtgatcaggccggggctccggggtctggtgctggatctacggatcaacgggggcggttccgacgcgctggcgctgcagattgccgagcgcctgaccgatcccgcgtacgtggcctacgccaagcgggcacgcaacgacccgatcgacccaggtcgccacacccgcccgcagccggtacgcgtccggccggcagccgaccggttccggtacaccggcccagtcgcagtgctcaccggcggtgagacctacagcgccggcgagaccctcacccaggccctcatacagcgcccggcgaggaccgtacgcattggacagaacacgcagggcgtcttctcggacgttctggagcgcaccctccagaacggctggtccttcggcctgccgaacgaggagtacctcaccccgtccggcggcaagaccttcgacggcgagggcatcccccctgacatccgcaccggcaacttccttgaggagatcgccaacggaacccacgactccgcgttcacacaggctctcgcggtaatacggcgccgcgccgagtaatgccgttcccgtccccttgcccgacagcaatgccagcggccgggtgctgtccgttctcgtggacatcgaccccagcctcgagtggttcgtatcggcatcccggagccgtacgccactcggcgcaccgaggccatggccgaccgggacaacgccttctggggcgaggccatccccaccatggaggagataaccggcaggaaaccgcgttcgctggccaacttcctgtccgactacgcgaccgcattcgcccggcagccgatctgagctctcggaggaccaggcgcgcccacgagatcattaacgcaattgcggatatagcctcacatttcccacctggtactccggggttggacaaacctgctcaactgcccacccgacgacacggcccggaggaagtagctgggacatggcgtctacacgtacacggtgggagatgtcgtggatgtcgatctgcgcaagctgcgctactgcctggtggtggccgaggagttgcacttcggtcgggccgccgagcggctgcacatcacccaaccggtgccgtcccggcagatccgcgcgctggagcaggagctgcacgcgcggctgttcaccaggaacaagcagaccacggtgcgcgcctcaatccgactctggctccgccgatgacccgccggatactcccctaggcatggtcgagtcggtcggccatgccggccaggtcgtcggcgtgcaggtcgaacccgtccgaggaggtgggcgggtcgccgacggggcgggcgacgtaggcggtgcgcaggccaaggctctgtgctccgcgcaggtcccaggcgtgggcggcgaccatcaggagccgctccggcggtcgcccggaaacggtgacggccagctggtagaccgctgggtccggcttgtaggtccgggcgtcttcggcggacagggcctggtgccagcgcagtccggcgtgcgcgttgagacccagcagcgccgtccggctcgcattggagagtccgatcagcgggaaccgttcggcgagccgggcgagccctgccacggtgtcaggccacggcgggagcctgcgccccgacagggccagcgccgctacggcggccgggtcgtcgactccgacggcgtcggcgacgagccgggcggcttccaggtcgaggacgtcgctggtgaggtagggccggacgccgtcgaggatgcgacgttgctcgcggtcgatgtgctgctgccacagcgacaaaagctgctcgaccctgggatcgtcgagggatgggtcgagttcacgaatgccggcgcggataccggcgggttcgtcgacgagcgtgccgagcacgtcgaacacgacggcatcgatctccagctctgacatgggcgaggtctcctggacgaagcaggggcgtaggagtggctgttcaccgaacgcagcgggaagcaccctgattcccgaaccgcacgacctgtgcggcaaccgcatcaacgtcgccgaccatcgcgccgccaagccgcaacccacgaccggcgcagcgcctctgcttgactgctgggtgggcgcgttgcgggtatcggacagcacagatcccggcagccagcgggctgccgggatcaaaagtgttgcgcctacttgcgcttgatggcgtccttggccttctccttggccgcgcgcaggtcgcccttggactcctcggcgtgccccttgcccttcagggactcgttgcccgccgcaccgccgacgaccttcttgaccttgcccttggcctgctcgccgttggcctgggccttctcgtccgcagccacaaccactcacccctgtctcactcgaaaacggttcactcccctctcaccccgaactccactctcaaacggaagattgccgcacgggcttttcgtaactctgggatctctgaaaactacataagatccgcaggagtggagatcgttccgcagggcacacgacggctcggaggttgataactatggttcctgttcttctcgttcttctgctcgctctgatcctcttcggtgccggtttcgcactcaaggccctgtggtggatcgctgtcatcgtgctggtcgtgtgggtgctcgggttcgtgatccgtcctgcgggaagcggcggtaagcggggccgctggtaccgctggtaggcgggcactgatcacgacctgacctcggtgggccccgacgccacctctcggggcccacccatgtcccgtctccctgtcacggcgggacgaaagcggtgattctgttgattcggggtagttggaggccatggccggaggatgccgtggcgccaggaaccacggcctccagcacggcacctccggccatacatatttcctcccgacataaatgtgtggggtccgggaggcagggcacccggccttctgagaaaacgtcaccgaattcgatgacgtctgtacgactttgcagttcaactgcgagggcagcaaaaaaatctcgatgagggagccgttttatgagtgacagcatctggggctaccagccgaccaccggccacaccgcgggcaccgacctgatcggatacaaggtcgaggccaccgacggcagtatcgggaaagtcgacaagcactcggacgacgtcaactcctcgtacctcgtcgtcgacaccggcgtgtggatcttcggcaagcacgttctgctgccggccgggaccgtgaagacggtcgaccaggccgagcgcaagatctatgtcgacctcacgaaggagcagatcaaggactccccggagttcgacaaggacaagcacgccggtgacgccggctaccacgagcaggtcggcagctactaccagagccaccgacgcgtctgacctcacagcgccaccccgcaagtggggccgaccaaagtgtctttggtcggccccacttctcgtgcgccagcaagcgtcgtcaagcggatggcccggggttgccggctccgttcccggatcgtgtggtgtgcattccctgaacgggggtacgcgcctggtgccggtctccagcagccggcggcacgggggctggatacacgtgggagggccctgagatgacagtgaccgaggcaacaagagcgcggacggtggcgctgccggagatagcggacccctcgggggtcgctcccaaggatgcccgtcaattgtcccggctgttcttcgacaggctcgccgttctggaagagggcacgcccgaataccagtacgcacgtaacaccctcatcgagatgaacgtcaccctcgtccgtttcgcggccgcgcgcttccgcagtcgcagccaggacgagatggaggacatcgtccaggtcggcacgatcgggctgatcaaggccatcgaccggttcgaactcacccgcgaagtcgagttcacctccttcgcggtcccctatatcgtcggtgagatcaagcgcttcttccgcgacacctcgtgggccgtgcacgtccctcgccgcctacaggaagcccgcatccagctcgccaaagccaccgaggagctccaaagcaggcttgaccgcatgcccacggtcaaggaactctccgagctgatgtgcctgagcgaggaggaggtcaacgaagcacgtctggcttccaacggctacacctcctcctccctcgacgccaccatcagctccagcaacgacggcgaagccgcgctggccgacttcatcggaaccgacgacaacgccctcgaactcgtcgaggacttcaacgccctggcccccatgatcgccgaactcgacgaccgcgaacggcgcatcatccacatgcggttcgtcgacgaactcacccaggcccagatcggcgaacacctcggcgtctcccagatgcacgtgtcccgcctgctctcccgtaccctcgccaagctgcgcgaaggcatgctcaccaccaactgaccccactcgttcgcaacacaccggcggcgctccgcaccctgcgagggtggggagcgccgcccgttcattccagcagccgggtacgaggcggccgaacgcaaaatcgctcggccggccgagcggacgcactcggcttgcccgtcgccttccgcgtccagaccctcgaagctgggcccgatccccaccaggcgccggatgtcggcatcgacctgggcgtcaccctgcccatcactctgtcggagggcgaaacgcacgagcccggcgaatggctgacccgcaaggagcaggccgggcgggcccgcgtgatgcacgcaacgcaatcggggtgatctccgcgtggaaggatctcgacgggagtaccggcgcggggatcggggatgaacggaatgatcgggagcgtgttccggactgcggacgtgcctgcggacaaccggttcgactattggtgggaactgatcggccggacccgctcaagcgagatcatcagtgctcacgccgctgacttctgggcggagtaccggctgatggagttaggtccggtggccgtgtggtcggcgtcgttcctgccgtcgcgttaccggcggagcccgagaatggtacgtcagtccgatcccgagacgtaccacctgacgctgctgctggacggcggactggctctcgaccatgccgggcggaccgacacgttcggtccacgtgacctgcacctggccgacagctcacggccgtacgatctccggtcgacgggcgatcgagagcaccacgtcgtcaagggagtggccgtggacttccccaaggcgctgctgcccctgccaccgcacctggtccgggggttgctgggccgggggttgtcggggcgggagggcctcggtgctctgctgacggacttcctcgtcggcctggaccggcaggccgacactctccagccgtccgacgcgccacgtctgggcacagtcgtactcgacctgctgtccgcctggctggcccaagtgctggacgcggagaccgccctgtcccaggagacccgccgggtggccacggcggaaagcatccgggcgttcatccgacagaatctgcacgatccggagctgtcgccacccgtgatcgccgccgcgcatcacatatccctcagctacctgcaccggatcttccagcaacaggcgcagggcgaaacggtcgcggcctatatccgcagtcaacggctggaaggcgcctgccgcgacctggccagcacctcactgcgcaccactcccatctacgccgtcgccgcccgctggggcttcctccacgcctccgacttcacccgcactttccgcaccgcctacggccgctcccccaaggaataccgccttcaggcgctgtacgtgccggagtagacgctcagccaggcggcatcagccggcttcaaccgcttcaggcctcgcctcgactcgtcgcgccgtacgccgatgccgcgacgggtacgcggacagaccaccgccgccccagtccggacctttcggctgtagacgcagcgtcaaggaagttggacgtattgctaacgacagccggacagcagcccgtcattcttgatccgtcgacagccgtcatggatcgctgggtgaacaggtcagggaagcgtggacaattacaacttcggctgggtcacgtcgcacaagtacaacaacagcgcgaacgcctccatctggatggccgggatgatgctggatccctccaagcccgcactctgcccgtgaacggcttcagcagcaacataggtgtggacggcgtcggggccgggtggaggactgtgcctgggtaacgcggttcctcagaccgtcatcgtcgagtaggcggtggcacatgacgcccggctgagcgcccaacgctcgcaaggcggggcaagtccaggcagatcagctccagccgttgaccggcgacttcggctgccccaccgagccaccgctcccgacaccgcgtccgggacggtgccgagaaccagcactcatcacatcacaaccgccgctggaatcactccgatcaccacgaatactcttctggagaagacatgatgtggaaacgcatattcgcaacgtccgcagccacgctgacactcctcggtggcagcatgctggccactgccgcaccggcacaagcagatggcacctgcccttcgaacgccctctgtatatgggattcgacgtccttcggcggcctcagaatcctgacacgcagcaccaacacctgcttcaacatggggaagttcgacttcggttacatccggtcctacgacaacaacctctccgtcaacggctacgtccacaactacgccggatccggtgtctggtaccaagcccgcactcttccggccggcgggttcagcagtgacatcggtgttccgggactcggcggtctcgcggaggactgggtctgcatgggttcagcagatctgagcgacttcgtctactgaccttttcggattggcttcgggggatctggggtgagggtcagtccggtttcggtgaggtagccgtcaatgagctcggggtgacgctggatgtgggcgagccctcggcggagggtgcgggtgaggtggtcggggtcggtgaatgcggtgttggccatcggcccgtgccgtaaccacgaccagatgccttccacgggattcaagtccgggctgtaggagggcagctggatgatggtgagccattcgtggctgcctgcgtactcccgcaatccggcagcacggtgggtgttcaaattgtcccagacgacaatgatcggggcgccgagctgcaggtgcgcgcggaccaggaggtcgcggtagtcctgccaggcgaagctcttgcgtgctcctttgaggagcaggtggaagcggggccggtagatcagccgggacctttcgccgggccggtagcagcacagtgcggcgaccgagatgcgtcgccgggaccgtccgcgcactctgactacgggagtctgtccgcgccggccccaggtgcgggcgtgtggcggcgtcatcgcgaacccggcctcgtcctcgaagacgatgtaggccccgagcgccgccgcggcacttccacctgcggccacacgtccttcttccagagctcgaccgcatgctcgtcgcgttccagcgcgcgacgggccgggctctgccaggaccagccgtggcggtgcagcagccgccacactcccgcgatcgagcaactgacctggaactggcggccgatcagcgttctgacgcgttccaatgtccaccgctggtcttcccagctatgcgcggccggccctttggccagctccttttccagcagggcgaaccgttcgtccgacagcttcggcagtttcgcaggtcccttcgacttcagaccctcgataccgccttcacgccagttgcggcgccattgctccaccgaacgctcgctcacccgcaggtctttggcgatgtccgaagtcctgtcacctcgtgcgaacctcaccccggcctccagccggatcccttcacgcgcagcccgccgctcagcggtcaggcccccaccatccgcgtaccgcatagcaccggcctaccgcagggatcacccaacgtcaccacccgaaggcaacccgaaaaggtcagtaactcgtgctgcacggcacgacagagcgcgaggggcccgcatgccgcatggcgggccccctcggcatggcatcgctgccgacactgtgcgagatgtcgagatcaagaagttccttgaatgggtggtggcagtggccgtggtgcacagaacgcagatacggaacatactgcggcgtggtgtcgcaggagtacttctcggcgcggccgtgacgtgggggtgtcagcccgtggcttcggcggacaacggaacggtcacccgtaccgcactcgcctccgacacggaattcaccacagggggcgctgtcgaactgatcggacgatcgataacgctgggcgccggtgaatcgcggcacgtgcgcgcccggttggaggcgacgagttcgacgaccgcggtcgtggggatgacgaacgccatccgatgtgtgaactcgtcaggcgtcaccgtaggtgtcaagtcggcctccgcacgcaatcacgagggctacgacacgacctcgtatgcgacggcaggacacctgccgatctacgcggacctgctcttcaccgcgccgtcggcgggtacgtacaggtgtggccttgtcgggtcgacatactcgacctccggttccgcctaccacctcaccgcggttgcgggaaacacctggatcgagatcagcgacaccgcccaggtcggcgcgggatggtggcagaacccctcgtgcgaaagcgccgataccaacggtgcctgcacatacgtcggcggaggggcggcggattccgaggcatgggtcttctacggcgacggcacaccggcgtccaaatgggaggctcacccctccgcgagaaccgtcgacgcgcaggcgaacctcgagctgacgacatgtcccgtcggcaccgcttcctgcgcgagtgcgatgcaggatcaccctcgcggcgagaacgcggtcgtggaccttcgattcgacttcatccagctcgacacgactgggcacgcctgcgcgactcatcagcagtcgtcacgtaaaaccatcacggacgacgcccatcactccgtgagctacttcgcgctctccgacatcccgatcaactcggcctgcggcacacggacattcatcatgcgcatctacgtcaaacacgtcgaggggcagaccctcaagatcgacggcgtgcagagcggggtcacttcgctgacgaacggaatcgcgttcaatcgcttttcctgacgccgcgccgcaagcgacatccggcgtacagcggcgcttcgccggacgcgtcgaagcgcctgagaccgcagcatccggccgcgtagatcgcttccgatccacgcgcagtccgcggtgaagtacgtccaggacccgtcgctactcaccagtcgttgatgaccctcttcatcggcgttgacctgcgggtcctggtggagggtctcgtgcgacaggatgtccccgggcaggcagaagtcctcgcagcggtggcgctggttgaacacggccggggcgtacgtcggggtgtggatgtcagcgcgcccgcacgatgtgaaatcttctccacgcgtggtggcggatgatgccgaaggagaagcggacgctcacgagcgcggaccgcgatccgccaggcccggccccacgcagatgatcagtatcggagtacggctcaagggggaaggcggcgcatggcgagcgtagacatggtgggaggggatgccggtgagcggtacccctgggtcaccatcgaggcgtgggccaagggtggggaggctgagcggatcggcgcggtcggtgaggcgctcgccgcggaggctcagcagatcgaggaacgactgagggtcctgcatcgcgacctcacgttcgtgcagcgggtcctggcactcactccggggcgaccgttcatggagcgacttctggccctgagtcgtcaggtgcgctattcgggggcgagcgacgagcgcctgctcgcgtcgctgatcgcggaggcgcagtccctcgacgacgcgctgtacgtcctgcggcatccggaaggcgaagagcaccatgcgctacgggcctgtctcttccacgagttgctcttgcgcggggcagcccccgacaagctggtcccccacgccacccagcgccccgatttccgcccgttccactggagcggcctttcctggttgccggcccggctctcggagatggaggggccggacctgagggcgtggttgccgaaccgtcgctatcaagggggtgcctccggaaccgtcccgacgatgaaatcgccgacgcctgtcgatgtggctgcacgccgggccggcgccgcccaccgcgtccgggaggccacgcccgcgcatctggccgacctgatcggccggccggccaaagacggcagatggtgcgaccacgaagcacgggtcttcgttctggacgagcccgtctctccggagaatctgccgggagtcgtgaccacgttgccgttggactgcttgcaagggctgggtgagcgggaccggttcgagggtgaggcatgcacgctcgactcggtctggctgacgttgttcatgactgcctcggccggcggattcggctcagcgggcgtccacggtgcctgggggcgtttcagcgcgtggctctccctcgcgggactgtgcggagccgagtaccccgaggcaagcgcttccgaggtcgaggagctggcccgggcctgtacgtggtaccggttcgaggccgacaccgaatggttccacaacgacctggacgactacggcatcgtcgccctctcccccgacggccgccgtatcgccgtactcgccgcgacggacaccgactgaaccgttccggcccggacccctggagtccgtcttcctctccgtccccaggggcaggatcggcttcttcccgggagcccaggtcaacacaccccaggtacgttggccaccgttcgcccactgcaatcagcgcacgccttcaccgtccgcgccgcggaaagcgccgcgctggaccgcggagttgcccgagctgcgcgacgggacaccccttcggcatccggtcgttgatctcgtggtcggtcgggaggcacggtgcaggggcgcgtgtgcccggcgcacctgctcccgagacgtgctccggcgcacgtattcccgtcggtgaaacggggtgcccgttcacctgtcgggtcgttagttcggttatgggtagatttagttcgagcggacgggccgtcgtccgcactgtcacagcattcctgctcctcgccgccacggccgtggccggtcccaccgccaccgccgatagcggcagccactcggcgccgtcggcggatcccgcggcgatccgcgagtggaacgtcatcgccaccgacaccatcaccgccagcctcggcgcccgtccctccgggcaggccgccatctggcacgggttcgtctcggccgccgtctacaacgccgtggtcggtatcgaggggcgctacgccccgtacaagtggcatgcgcgcgggccctccaccgcatcccccgaggcagcggccgtgaccgccgcgcaccacgtactgctcacctacttccccgcctcccgggccccgctcgatgccgcatacgccgggtcgctcgccaagatccccgagggccaggcgaagaggcagggcgtggccttcggggaacgtgccgccgagcacctcatcgaactgcgcgaaggggacggccggttcgcaccggtggagttcaccgcttcgcccgcgcccggcgtctggcggcccaccccgcccgcctacctgcccttcatcgacacctggctcggcaggcttcgcccgctgctgctcacttccccggatcagttccggccgggcgggccgcccgctctttcctcggcccgctacgccgaggatgtgaacgaggtgaagaccatgggggcgaagagcggctcgtcccgcactgccccgcagaccgaaaccgccctgttcttcgggggcaacctggtggtgcagttccaagaggcgttccgggactacaccgcccggcaccatctgggcatcgccgagacagcgcggctgttcgtcgcggggaacgcgtcggcgaccgacgccgtcgtcgccacttgggacgccaaactccactacggattctggcggccgatcacggcgattcatctggccgacaccgacggcaaccccgcgaccgaagccgacccgcagtggcagccgttgctcgtcacaccgccgcatcccgactacgtcagcggccacgccgcggtcgccggcgccgtgacccagaccctgagcgggattctcgggaccacacgcctcgacctcaacgtctcctccgagatcaccggcaccacacgacactacgaatacgccgaccagttcaacaaggacatgatcaacgcccgcgtctggtccggaatccactcccgcacggcggacaccgcaggctgccgggccggcaaccgcgtcggcgcctggacattcacccactacttccaaccgctgcactcaccgcgcctgcacgccacgccgccgatccagccgacgtgcccgctcggcagcgcgagctgacgagacccggctcgatgcacctgggcttctggggcgcccgatggtcctgggcgcccgcaggcgggccatgacctgcgccgaggcgagtgcgtccccggccccgccggggtaaggacgaacgccgggcgggcggcaccgccccatcgcggacacgatggatggtggtggccgctgggccgcgaaaccgtcgttcaaggcatgaccgtccagcacgccgccggggccacttgtggcggccccggcggcctcgaaccaacccctcgggagggtccatgcacggcggcatagtgggccaggtagatctcggcctgttcggctgagctgccggtggccggcggccggccctggggcgtgtccgatgggtcggccgggcggtccgccgtgaccagccacgacgtgctgcgtagccggaccgtgccgtccgccgcctcgtggtcgcgcagaaggcccgtcagggtgcggcgggcgcgggcccgtgcagtcgcgtcggcctgctccatcaggtggcgaccggggcccgttcccagcaggaactccgccgcgtcctcggctccgtgtccccatgccccgtacgtctgcgcctggttgatggtgatgccggtgaacccagccacggtgaggacgtggcggatacggtccggggcggccaagggctgtcccggtctcccgaagtcgccgagcggcaggaagtcgcgcagtgacgccaccgccgccacccagccgttgagcgtggcatcggccgggcagacgaacgccaggcgcccgccgggtctcagcgcccggccgacgttgacgaaggccgctaaggggtcggcgaagaacatcaccccgtagcggctgatcgccacgtcgaacgcgcccgcctcgaaggggtacacctgcacgtcgcctcgcgtgaaggaggcgttggcgatgccctcccgctccgcgcgggccggtccgtcaccgccgaggcgggctgcgccaaggggctgttgcacacgcacttcgcagggctcgatgagttcgtggccgagctctgcctcgaccggttcgcgcggacggcggcgaaggcgcaggcgctgtcggggctcgccgggcagggcactgtggcgcggaacctcgacgccgtcgccctcgcgctgttcgactccggcggcccggccatgtcgggcctcgccatgacccgccccgccgccgcgctgcgcatccgcgaggctctggtagacggggcgcccggcttcaccgcgatccaggaggccatcaccggctacctgaaggccgagcgggggctcggccgggtggcggagaccgtcgacccgcgcaccgtggccctcgccatcgtcggcaccgcccaccacctactgatgaccagctggccgggcgcacctgacccacgaccgcatatggcgcgcctggtggccgcgttggtggacagctagggactgtccagcgagtcaggagcggagccagagacgtacggcagcaacggtcaccggtagggacgggtccggcgcgccggatcgtgaccgccaacgcgtacggcgtcgctgcggcttcggcgtccgggcgggcgggctcggcgacttcatcgcgggcgcggggcccacggtctgtggcgtctgctcgggctcgggaaccggcgtgtgcgcaccgtcgcgggcgggcggccggaagggaggccgctccggtggaatgggccggccgacgatcctgtcggggaggcgcgggtcggattccagagcctgccacacgcggtctggggcatcgaagggcggcggcgggcgcccctcggtcagggctgcgaaaccggcggcaatgcggttgagctcggtgagaccggcggcctcgcatgcgcggcacgccgccagcagggccaccgcacgctgggtggagggtcggcagcgccgatggcgtggacgaggcggggtcgaatgggtcggcagcgccgatggcgtggacgaggcggggtcgaatgggagcaggccgtgcacattgccaccgacgctgacgctgcgcaggtccggctgggcagtcgcccagccccatttctcatcgttcgtaggcgagccggtgctctctttctgcttgctcctgcacgaggcgagcgaggcgtccggcttcggtgcgttcggcgggtgtgaggtctgcttcaggacgcggtccggcgcgggcggggcgggccggactgcaccaggtagcagtcgagttggggctcttcgtccagccgggtgtcctgctggcgtgcctcgtccgcgcctttggcgccggcgaacgcgtccgcgaggtacggaccgaagcggtccgtcgccctcgccgtggatcaggtgaaggcggtgctcagcgtgtccccggtctgcgaacaggcacccggcgatgtcgtcccggtcagcccgccgccgtccgctgccgcgccaccagggagtcaccgggtgtccgaccgccatcccggggcactctggagcgtacgacccggcgattacccggcgtcgcggcggatggacagaaaggcggcgtgacgtgcggactgtcggagtggaggaggagctcctcctggtcgacccggagaccggagagccgaaggcgctgtccaccgcggtgctcgcccgggctgagcaggtcgatccggaccaggacgtgttcgagaaagagctgcacggccagatgctggagttcgccacgcatccgcagacggacatggcggccctcggtgcggagatcgtccgttgccgcaaggaggcggctcggcacgcgggggaagccgggtgtgcggtggcagcactggccacctctcccctgccggtcagcccctccatcgccatgaaccgccgctaccagtggatggccgagcagtacggcatcgccatgcaggagcagctcacctgcggatgccatgtccacgtagctgtcgagtccgatgaggagggcgtcgcggtcgtggaccgcatccggccctggcttcccgtgctggtcgcactcagcgcgaactccccgttctggcagggcagggactcgtcctacgagagctaccgcagccgcgtatgggggcgctggccgtcggccggtcccaccgagctgttcgggtcgccggagcggtaccaccggcaggtggcggacatggtggccaccggcgtcatcctcgacgacgggatggtgtacttcgacgcacgcctgtcccaccggtacccgacggtggagatccgggtcgcggacgtctgtctgcacccggacaccgcccagttgatcgccacgctcgcccgcgggctcgtggagagcgccgcgcgcgactggcgggcgggccgggaaccggaagaccacagcgtgagcctgctgcggctggccgcatggcaggccgcccgggccggcctgtcgggggagctgctccatccggtgaccatgcggcggctgcgggccgagtcggtagtgcgtgctctgctggagcacgtcggtgacgccctggctgacgcaggtgaccttgacctggcccacgaggccgtggccgagctgctggagcgcggcaacggtgctcgggtgcagcgcgagctgctggagcggaccgggagcctgcgcgacaccgtcaccgagtgcgtacgccaaacccaggggtgagccctcagcctgcacgacggcctgcactacgggccgtcgtcgcacggctgactgccgattagctccacgccgcccccgtgaggccgtgccgacatcctccgacaatgcgggacgagcgtgcgcagggtcggcgtccgaaccgggcagagccgaccgggcagggcggtcttctcgccctgcccggtccgggtccggagcgacgggcagtgctccgggtccagcccggccggccctcgatcatcatccagaccctcgtgcccacgcctgaggcagtaccggcgtcggatccggtgacaacgtgaggtccgttgccggtcgccggtcgccggtcgccggtcacggtgcaggaatcagtccgggccgcgcgtgggcgcgcgttgccgtgtcaggccggggccggcctggaacggcgcgcgggtcaggtgtcgtcggacgtggcccactcgacgaactggatgatcactccgttggggtcggtgatctggaacaggcgctcaccccagggttcctcgcgcagcggcatggtgatctcgactcccgcctcgcgcaggcgcttctcctggtcgtggaggccgtcggcgagggtgaaggccaggatcaggccggcggcgtgccggtcgcgctgttcgggcggcaggacctgggtgccgcgggcgagcaggacgatgtccaccgcgtcggcgcgggtgagggaggcgaagccgtcggcggcggcctggacggtgtagcccaggtgggcggtgaggaacgcctgggaggcggcgacgtcggcgacggtgagcgagacggtggacgcggtgatctgcaagagggtctccctgctgaacgggtagggcgggctgcggagccggtggcggtggcgggtcagtagccgcggcggcgggggatgttgcggacgacccggggctcacgccgtccccgcacggcccggtcggcggccaggcggcgaaggtcgtagcccccgcgcggcgcggggtcgcggacgtcgcgcccggccgggacttcgccgaggccgatcgtgagggcagaaaccgtggtgcggtcgagttcgaacatgcactctcctctccgttccctcgtcgcaaacttgcaacggacgtaaatttagcctggtctacatgggggcgtcaatataaaaatgccacgagggtaagattgctccatgggtaccgagatcacatcgcccgcacaacccgtcggcctgcgggaatccaagaagcacgagacccggcagctcatctccgaccacgccacccggctgttcctcgcccagggcttcgagcagaccaccatcgcggagatcgccgccgccgcccgcatggccaagaagaccgtcaccaactacttcgcccgcaaggaagacctggccctggaccaccaggaggagttcaccgcttcgctggccaacgccgtcgccgaccgccgccccggcgaatcggccctggccgccctgctccgcgccttccacgactccctcgccacccagaacccggtcgccgggttctccggcccggccttcgcccgcatggtcgccgacagccccaccctgaccgcctgcctgcgcggcctgcacgaccagcgcgaacaccgcctcgcccaagccctggccgacgccaccgacaccacacccgacgacatcaccgtccacatcgccgccgggctgctgggcaccgtccaccgcgtgctgttccagcgcatccaggacctcaccctggcgggccaccccaatgaccggatcgcccacaccatcaccgccgaagccacccaggccttcgacctgctggaacccgccctcgcccactacgccaccgcctgaaccacccgcttcaccccacggccggggtcagcgctgacgccctcaccccggccgaaacgccgcacatcgagtcatctgacacaggacacgtgtgtcatcgggccccgacgggtgcgagttcgcaccaaccaagtccgcaccaaccaagtccgcacagtgagacggcaggtcttgatcggtgacttcgccgaagaggacgcggacgactacctcgcccgtcgcctgtcccgcgacgggcagcccctcatcgcaggcgacatccgcgccgtcatatcccgccgttcgcacggcttgccgctccacctggacctgtcggtcacgagatatccggagacccgccgcaccggccgtaccccgcagtccgcagtccgccgacttcgaagccgacttcccggcgctggtctcccgcaccctgtccgacctcacccctggcgaacggcacgtcctgcgctccgtcagcctcctggactccttcgacgtgccactcgtgacccgggccgcggggacggcccacgacgcgccagccctgcggctcaccgagcggcccttcgtccgcgaaaaccctggtacgtgccgtggagcagcgcggcccgcgccgccaggtgctcacccggatcgctgggcagtttcagggaggccagcacggtcggacggacctgctcccacgtctcgccgtccagcagcttcgcccgcgggtcgcccgaaccaacaccgcgggagcgccgtcgtcggcaccatggaagccgtcaccccgaaggagtggctggctgtcctcgcggtcagcctcgacgccgtccaccacaccggccgagccgcgctccggcacctgcgcgccgcgcggggctccaacgtcggatcggcgggagggcttggcggcgactacggcatggccgcctacaacgccgccaagggcgcggtggtcaacctcacgcgcgcgatggcccttgaccacgcccccgaagtccgcgtcaacgccggccaccccggattcacgctccactccgggatcaccgcgggcgccacccctgacacgcccgtcgtgcggtccttcgcggaacgcatccccttgggccgcgtcgccgaacccgacgagatcgcgagcgtcgtcgccttcctcgcgggccccgatgcgctatatgaccgacgctcaaatcccggtcgacgggagcctcaccgctgctaccgggcagccccgcatcgggatgtgaacgcgtcctgacacaccccgaaccggtgggccgccccgtcatcacccgtgtcacgtacgccgaagagcccgtcaggacacacggcggttgctccgtgagccgggccctgaagcgcgctgtgcgcgacgagcgggcccaccgccgacggaccgcgcgcggtactcaactcacctgcaaccttggagagttactcctcctatctcagttccctgcgaagatcaggggatggccaggaacgacgcctctaccgccgtcccgacaccgcgtggtcggggcgcgtgcgccgcctcgggtccgagcccggacagcacgtccggcgcgacctgatcaccctcaaggcggccggagtgctcgacggcttcctggacctcgaccccgccgaggcggtccgctccaccgtcctgcgccgggacgagtccgccgacgccggcagtactcggcctcgagctccggcttgcgcgcgaggttcgtggctgtcgccctgctacgccctggtgtctgccggtcccggttggtgttcctcggtgtcctgcccggcggcaggggcgggttccgttggttcggttgctacgacgaccacctggtcgtcggcactccattcgcggcgctcgctcttgtcggggttgagccggatcccgtggtccgggggaatcgcccggcggtcgtgacggcggtagccgatggcacattcaccgcggtcgcgcgcagcggccacgacagtggcgaaggtggtttcgcagcccgtccggacgtagtgccctgcctgtcgcaggcagatcgtgctgccatcggcggagaacaactcgtcgaacacgggcgccagatgccgattctgcgcgatttgcgccaggagtagtccggtcagctctccgctgacgatgacgtcggagccgggattgacgggtgccaggggccgattgcggtcgtcggtgagttcggtgatcacgcgcatttcgcgtccggtacgttcttccagcagccgcagggccagcagggtgaccaatgtccggtcgtcggggcggtcaggaccgtcacccggctcggggccgaggacgatcagcccgtcgtagggggcgaggtcgagcccgagcagggtctcggggcgtgacaggtcggcggactggaaccgcacggccagccgggcggcccccgattccggttcccgcgtcggcccgggcacggccctgtccgtgactacgtccaggacggaacccggccgggccgtgcgccgcaactggttgacgacgaggggcgcccgccggttccagccgagcagcagcaggtgcgcggcatcctccggcggtggctgggccatggcgatcgccgacggctcgacaaggtgccggcagtcctccggccgtgccgaaccgtcgtcgcgtgtgaggactaccaggcgacttcctggtgctacgagtgtggcggcgggcggattcagcagcgtacgtccctcggcggtgagcaatccgaccacacaggacgtggcatggcccagaagggccgctccgaagggacccccgtggaaggcggtcgcttcggcgaggtggaactcgtcgccggcgaagtcgagcagatcgcgcaggacgagggacagcccggggcggccgacgcactgcgcgatcagcctggccgtgacggtgtcggtttccaggacagtgccgcgcgggcctgcggccagccgggccggtgcccggtaacggtcgtccagtaccgcggccagcaccggcggtccgccggtcccctcgccgagcaccgcccgcagtgccagcagaacgcgcaacacctcggcgtcggccgtcggttcgccggacggcagcaccagcacggtgctcgccgtctgcgggctgaccaaggcgagcacgccggggtcgctggcgggaccgctgcggcagacgagccgggtccggccggccggaccgacgtgagcggccagcgcccgctccatctcggtcttgtccctctcggcgagcacgacgacagcccgtggccggtacgacgactgggcggcgaccagctcacccacgaccgtggacacctggtccgaccagccgagcacgacggcatggccctgttccagcaccgtcgaccgtccgcggctcaactccgccagccgctcggccaggcctgtggtgatcaccccgacaagggtcgacacgcacagcagggcgacgagcccgagcagggccgacagcagcatgcgcagcggtgtgccggtcaccgtgcccagtcgcagtgtctccgcgctgctccgccacacggccgccagccggcccgacagtgaccgcggcgagccggggtccgtccacaccagcagcgcactcaccgggacgacgacggccaggcagatgatcaccagccagcccatcagggtgccggtactgcgggccagcgtgcggtcgaaccagtagcgtgcccggtcctgtaacgaaaccggccgccggtccttcgaacgttccactcccgtcccgcctttgtcttgtaccgcgctgcctgcggcaaccgtcctggaggggtgtctgtcgtgccggtcggcacgacgcccggcagtgccggccggcactgcccgccaccgcacagtgctgcgttcggtaccgggacacgcggtattcgggagccgattcattctttcgggcaggcaccccgccggacgagccgaccagggccgacccggcggccgacctattggaggccgaggcggttgcctccgtgtccggcgaggaagagcgagagcgggcggtcgacgggacacggccggtgcggccggtgccgcgccgggaaggtccgcgccggatgctgccgccgaactgacaggggcggcagtggtggtgcgacagggcgcgcacccctggagcagcaagtgcactgcctgctgcagcgccttggcggcttcaccggcacggcctgctccagggaggcagtgcccgtagctcctgcgtggcccgtacaggcacgccggcagcattctgcgcctgctccggctgggcgcgtcgagcgcggtcggccttgcgtcggccggcggtcggcctgccgagcaaccacagcacggccgcgccgagcacgaacacggcccgcccctacggcccctgcgccgggagggacgaacacccggacaggcgtcccgaccagcccggcaaccatcacgcagcggactgccgcggtgaccatctcggcacggtcatcgccccgtcggttgagggatggcctccgccaccgggtcacccccgccactctgcgcaccgtccggtgccaccgaccgccagcccacagcggcgcgaccccatcccgtgcaccctttgacgcgctccgaagagaggaggcgacgatgtcgcgcccctcaccgtccccgatccggcggcgcgcgccgagacttgagacacgttttacgcaacgcacgcaactgcggcccacgccatcgctgtctgacagagagtcgggcccgccagggccgaagagcgagagagcggggcaggtcgtgggacggcgcaagggcggcatagggatcgcactcgtcacgagtgtgatgctggtaggcgcgagtgcctgcggcgggggcagcggtgacaaggcgaacggggacgacgcaaaggcgtcgggaaagccgggggcgagcgcctctccgtcaccgaagaagcccgcgggcccgccgatgctgctggagacgatcaccccgcagacgggaaccacggtcggcgtggccatgccgatctcggtggtcttcacgaacccggtggcggcaaaggcacgggccgcggtggagaagcacatgaaggtgagcgcctcacagccggtgtccggcgcctggcactggttcggcgacaagcgcgccgactggcgaccgaagacgtactggccctccggcacgaaggtgaagatcgacgctgacatgaagggcgtcaacaacggcaacggacgctacggcgtgcacagttacacgcacaccttcaagatcggtgacgacgtgcgcgcggatgtctcggtgaccggccacaccatgaaggtgacccggaacggcaaggtggtgcggaccctgtcgatcaatgcgggcagcgctcagtatccgacgtggaacggcacgatggccgtcatcgacaagcaggagaaggtccacatgacctcctgcagcgtgggcatcagctgtgagaagggcagccccaactactacgacctgacgctgccctgggacgtccacctgacccagtccggcacgtacgtgcactactcgaccggggaccccactccgggcagcggcagcgcccgcggctcgcacggctgcgtccacctgtccatgtcggacgccaagtggttctacggccaggtcaagcagggcgaccccgtcaccatcaccggctcgccccgcgccaaggccccggccgacaacggctacgccgacttcaacctgggatgggaccagtggctcgcgggcagcgcgtccggggagaagacgaccgcgacgctgtgacgcgccgcggtggcggcgccggtcagcacgcgatggtgtcgaccgcgaggcctctgccgttctagcccttcggcctgatcagaaacggctggccctccgacacaccccgctcgtccaaccgctgttcgagttgggttcggctacgaccccgccgaggcccagccagtgctgacctgcgcacgcgccagtaccaggccctgtcacacttcacaccgcaggaacgctacgaactcgccgcacaacttcatcggctcgccggcatcatcggcgacaccatcccccagccggccatggggaaggccatgcagcactgacaggggatgccgaggcgagcaggctgacagccaacctggccgatcatcagcttcaactcctcgccgccttcaatgacgcactcggctccccgcgccttgcccccgccctcgcccgcccgtcggcacctcgccgcccctgtacccggcgccactcactggagcggccgccaaccccaatctgcaatgtcgcgagggcgagaccgacgatcccgaaaggccccggcaactaccgctcgttgaactggcggcgctccggacccatagctggatctcgcgttggctgcagatccagcaagtcgcccaagacgcggttcgcggcccaggctgtgactgacagccgctctcctcagtgggccactacagcactctgccgctccagctacggctctccgcggcgtccgatcggtcggcgcagcgtcccgtttaccggggggggccagtcagtagaggtcgtctcgtttggcgccgaagggcagaacctgagctcggtgggttcagatgttcaagggcggcgagagccgtcaacgggcggcgtagggcggttcagtcgccagaccacgtcgatcccactgccagagggagctgcgggcggcgttacctgttcacgccggacttcggtgaagcccaaccggcgcggaatggcggcgctggaggtgttggccaagtcgtgcgcgacttccaggtactccacgtccggcagggtgaacatctcggtgaccatggctgcggtcgctctcgtggcgatgccctggccggtggcggcagggtgcagccagtacccgatgcgccggccctgaggttcggccccgcggtaggtctggcacatgccgatgagagtcccgtctttggcgatggcgtagttgtacacgtcaccgtttgcccacttcgactcggacttcgcgaggaagtcccgggtgctctcctcgctgtgacgggcgacccacggctcccaggggcgcaggtggtccagagactcctcgatcaacttgaatgccggagcgaagtctctctgcccccgccagcttcgcagaacgaagtctccacactcgatgatctgcctcggtcgcgccatgacggccatgattgctcgcggtacggctctctgcaacgggatgcaaaagaactggtgtcggggggggcggcagtggttgccgtgccgctggccgaggcccggggtctgtcagggctgtggggtgcgctcgcgtgcgccaacgcgttgctggtggccgggcagcacccgtccttccgacgccacggctctctgctggcggtggcggtggcggacgggttgtacgggtactggcccgaggcggttcgaccggatctcggccgcctgtttcttccgcgcggtacccccggccctgctcacgcaggcccggcccggcgggaagatcctgctcactctgtcgggctggctctacggatacgcacgggtgctgctcacggtggccgatgacggaaccgccgagggccaactgcgcggtgacacagtgtcgttcatgtcggcgcgcagacacgcggcgccgacgtatggcaacccggctcactgggccacgggtctgccggagaaggcccgtacgacgcggcacagtcccgagcggatcaccatcgccaccgatgaagcgctccacctgcggttcctcgcccaaagcgccgtgtccgacgcgcagatgaccaccgtcggggacgtggtgcacctggtggacgtcgtcactggctcccgcgaccctcacccctggcgaggacagttgggctgtacgcgagggggccggtgaagctgtggcagcggatcgagcgtgtcctgggcatcccactgaagtcgacgatcaggtcgtatcgttcggctgaactgatcaggaaatcgagcattttcaacggagcgcggaagccgccgtctgtaccgatcagccagaacggcagttggggctgaagaagtacgtctctgggaacgtcgaacctcagccgccagaaaggctcgttcgaggcgttgagaatgcgcagccggtagcgtcgcggctccactgccaggaatgggtacgccttcccgttgaagaccggggtgtcctcgccttccctcgcggtcatggtgtaggcgagcgagccgtcctggttgaaggtccggtcccgcaggatgagggggacctcgaatgcgcctcgcggcagcccgagccgctcgtccacggggtcacgaacgaggtagagaccgggaaggcccgcatagacgttgagagcgctcatccccatggcgtgatcgtgataccagagcatgcacgaacggtcgtggttggtgtagccgtagatcgcttcgttgggtttggcccggctcggttccagggtggcgtagtcctcggcatggaagccgtgcgggctgaacgcctgcatcggcaggccgtcggactgtggtgctgtgtaaccgccgtgctggtgtacgacgttccacagtgatccctggtcacgctgaaggtcggcccgagatagcccatgccgatcggcttgtgaggatggtgcgggttcgtggcccagtagccccacacgggtgacggccccaggtcccggtggaagcgccacgagccctgccgcatcgtgagctcgtagtagtcggcacccggatagacgtaaggatccgagatggctgtcagcggcctgggcagcgggtcgacgtacttctccagcggaggggtgcttggcgtccccgggggggccgtacaccctgccggcgggtgagccggcgccgcatacgcccgcgctcccggaacaccctttggaagcatggccgcacccaccgctcgccgactcggctgcttcgtgtgccgcgcccctgggtccgattggctcaggcacggcgcgcctcggccgtgcgggcggccgccggtggaggatcggtggggcggcggcctggcgacgggccgtccggcatcgcccaccgcgtgaagaggtccggccatgaaacagttcgacgacccgctgttccggtctctcgccgaccgggcactggaactcatcaaggacgacaccctcggcgtcacgccccccgcgacgtgaccgccgctccgtgcggggacgcgccgggcggcggccgctacggcgaggccgtcttccgtcccgaagaggcgggcgagggcgagcgcatcgacttcggcgccctcgcctacgacggcatcaccatggcgcggctgcgggcgctcggggtcggcccggggtggcgctgcctcgacgtgggtgccggcacgggcacggtctcccgtcggctgctggccgaggccggggtggcgagcgtgctcgctgtggaccgcgacgtacgttttctcagcgcgcggcccgtgcccgggctcgacgtgctggagtccgacatcactgcccccgacttcgcccccggccggttccggctcgtccacgcgcgcttcgtgctgatgcacctgcccgggcatgaccgcctgatcacagcattggccgaactcgtcgcgcccggcggtgtgctggtgctcagcgacgcgatcgacctgacgagcgaccgaacacccggcacgccgtacagcgcggtgatgcgggcgatgtggcaggggctgcgggccactatcggcaccgatgtctcctgggtgccgtcgtatccgcatctgctgcgtggggcggggctcgtgtccgtcgctgccgaggtccatgtgccgccgctgctgccgggcagtcccatcagccacttctgggcggacacgtgggagcgaagcagagtggcgatgctcgccaccggcctggtcgacgacgcggccgtcgacgcggcgctccggtacctgggctccgacgaatgcgccgcgctgtcggccggcatgctctccgcctggggatggaaacccgaggagggcccgcgatgacccggcccgacccccagctgtgacgctcaagatgccaactcaggtactcacgggaggaagacggggcctgagcagttggctcagcacggcccccttcggatcagggctgtggctcggccttgcgggcgtgctgcgtggccttccacgtctcaggcaggaagcggtgcttgagggcggtgcgcttggtggcggcgtcaccgccgacgacttcggctcggccgtccatcagggcaagaaacccctggcgggcgacgtccttgcggctgttcttcttcatgccggagccgaaggcggtgttgttcatgccggcgcgggcgtggaaggcgctgtcggtggcgccgggcatgagggtggtgacatcggccccgtgctccttgagctcttcgcgcgggccgagggcgaacatgcgggtgaaaggcgcgggaaggtccgtagacggtttcgtacggggtgggcatggtcgcgggcagcgacgaggtgatcaggatgcggccatcaggcgttcctggaggaccaggctcgcggcgaagccgacggaggcgaccgtggcggccacggccgacatcgccactcccggccgtaggacgaagaacagatagggagccgccagcagcaggcgcagcggggtcgcgagacgagagcgcaccgcgggtggtaccaggcgacccaccgccatgtcgcccacgaacatgcccagcgccccgcacgcgtacagcgtgccggcggcttggggggcgtaggagacgtagagcgaatcgctgccgaccaccaggccgttggggacccacaggcccaggtacgtcaggcggcgggggcgtgaggaccacaggagggcgttggcgcgccaggtcgccgagagggacgggcggcccaagaagcgcggtgggcgggccgtgagacccaggcgggtgacgagggccgacatcacgtacagcgccgccgcgaggagcagacaggtccgtggggacaggagcgccagcagtgcgccgcccgtcgcgaaaccggccatctgcaccaggccccagagcatgttgaacacggaacggcccaggacatagccgtctttcggcaggatctcgttcagcagtcccccgcgcactcccccgcccagcgacgcgaccaggccctgcaggagtacgacggcgaagaccgcccggaccggcagaccgggcagcgccagcaccgccgtaccggccgcgaaggcgagggcgaggccggaaaggatcgcgcgcgggggcaggcggtcggcgcccgagagcaggaacgtggcccccagcaactgcgccagctacgggccgaacatgctcaccgccgacaggagcggggagccggtggcccggaagaccagcgtggcgagggccagtccgccgaccgtctgggccgcggcgaaagcggcgaaggagagcaggaacggggcgaactccggggcgcggaacagggttcggtagctgcgcatgcgtcggagtctcggagcggcccagggaccttgtttgctcattcgccgacacgcgaaaggtcataaggtgctcatggaggcatcgggagccgaacccggggaccgggacccggaaccggggatccaccaggtcctgtatcgatcgcgttcgccccgcttagccaccgacagtgtgaatcccgattaaccgcgcagtccacggcagcaggctccggccgtctccgggcctgcccatgcggacgggtgctaccggaggagcgggatcaccgccttcacggccggggtgagcggcgcctcctggccgaagagggcggagccgacgccgatcgcgacgtgcgcgagagctgtcgtcgcggcgcacaggacgcggcctgggtcgcggtgagcgcaccgccggtcgcgatgacgaggaaggcaatggtgatcgcggcggcggtgacgagcaccgcgatcagcgcggggacgggcagtggaacatgaagtccttcccggccggacgttcgcccggctcaccccttccgccgcgaaccaggccgccttaccggatcgaaacccgacgcacgatgcacatcacacatgcgtcccggccgccgcacggcgcccttccccgccctacagggctgtgcctgagcacgctaattggccaaatgagcatcacggttggccacagtcacaggctggatgcgggtgagccgggtgacgaacagagtcgcgtcgtccgccgagttggtggggcgtgcggccatgagagcgtcgcacacctcgtccaaggaagcctcggtgttgtgtacggcccgacgcagcatggcgatcccctgttcgaggtccaggaacgtgctgcggtcttcgatcatgccgtcggtgtagaggacgagcaggctcccggccgggacgacgtggtgggcgtcctcgtacacgtggtcaagccccatacccacgggcggcccggggtcggccgccaatatgtccgccgacccgtccgggcggaccagcagcggcggcgggtggccggccagtgcgagccgcaggtctccggtgacgccgtcgtagacggcgcaggcgcacgtggcggggaggtcgttgtcggctccatcgtccagaccgtcgaggcgggtgaggagctggccgggttccaggcccacggccagcagtgcgcgtgccgatgagcggtagcgccccatggctgctgccgcgcccagcccgtgtcccatcacgtcaccgatggtcaacccgatcctcccgccggggagttgcacggtgtcgtaccagtcgccgccggccagggtgccgttctgggcaggcagataacggtgtgcagattcagcccaggggatgtcaggcaggcgtgcgggcagcagctggcgctggagggtcaacgtggccagccgttcccgccgatagagcagggcattgtcgatggccatcgcggtgcgagcggcgatgtcgcgcatggtgagcacatcatcaggatcgaagccgcccggtcttgtgaaggcgatcgctcccaggacctgtccggcggccaggagcggtacggcgattccgtggtgcggctgttcctgggcctcgtccacgcgaaagggcacaacggcgaccgagctgatgcactcaccgacgggggcagatgccgcgcagggcggcggcagatcccgttccggctcgcgatggccgctgcctgcggaggtgctcagagggtggacccgcaggccgtcggacgcgtctgggccggcagagcccgctctctcggtggcagtgcgcgtcggcaagtccgggtcgcgatgcactgcccctgcgaggagatcgacgttgaccgtccgggcgaatgcagggacgcagactgccgacagcttcgcagcgacgctggccacgtccaggccctgactgagggcggcgctgatccggctgagcagttccaggcggcgctggcttcgcgcggtgtccagcagttccgctctcgcgtcacccaggtcgtgcaccacgccggcctgacccacgatgtggccgtcggcgtcccgaagcgggaagagggttcctacggccgcgtacggagtgccgtcggctctgatcgcggcgacgtgcagactgtcgatcgtttcaccgccgtcagcgacacgccgcagcatgtcctcgtacgcctgcggatcggggagatccaggacatccagaatgcagcgacccaggtgtgcagcgacgggcaggccgttgagacgggcgagggcgtcgttgacgaagcggtatcgcaggtctttgtcgaggacggccagaccgatcggcgacgattgcagaagaaggtcgactgccgcgggatcaccctgatggatccgctggccgccaaggctcgctacggcgaccagacccgtaccggcaacgagccggaccggcacggcccgccagcggacgctacggcaagtaccgtcgaaacagcgcagccagtccgtgcggacaccatcgccagcccgcaccaactgagcgacgagttcactgccgtggctggtggctcggtccgcgagtacggacacatcgcgaccgatgatctccgacggcggatggccggtcagcgtctgtgcctcggaactccacagaccgatacggcccgcaggatcgacgagcgcgatggccaggccatcgtcggctgccgccgcgggcaggccgcccggctgcacctcatacggccgtggtggctcatgcgggacagacaccgagaccacctaccgtgtgtcatcgttgcggcacaacatgatctccttgcgggcgaacggcatcttccgaaccctgctctcgcccagcacaagctatggggccgtctccaattcttccgggagtggctgggtgtgtcactcggaggagtgattcggccagggcgggggtcaccgacaaccacgaccagccctgtccaagcagcgaccggggccctccacgagcgcgggttcaaactctcgccgagcaccggaactcctgagcaccggagtggccggctactgcgcccgctacggcgcttccctccccggcgccctcgtacagcgcgccgctgagcgcgggatgacgacactcgcgccgaccggccgggacaccgtcgcaggtacggtccgcttcctcttcctcacggccgccgcggcagccggcagccggcccgtcctcggagtcgacgtcgcccgtcgcccctctcggcccgccgggcccgtctgccggacggccgcgtacgcccgtacacggcggcgtgcacgtgacggagccgcccctgcggaccactttgctcgcacagaacttgctcgcacagaacgcggccgggtggacctggctgtgcctctggtgtccgccgcgcacgccgaggccgacggcgccctgccggtgtcctgacctgtcctgcgcgcgtacgccgaccagaacctggtgatgctgctcggtcccaccgccgaaccggtccgggccctgtccgccggccgccccgacgtcgccgagcggctgctcgcgccggggcgggggctggccggggagcggctgcgcctggaagccgtgtatccgggtcggcagggcaccggcgcgggctcgctacggctggtcgcgcgcaccgtgggcctggcagaccagcccggggtgcgcgcggtgctgacgaactgggccattggagtacgacgcggcccgcatgatgttcaagcgcgccgacgagctcctgggcgccaaccggaccctccacgacctgcgtcacactgcgccgcgagctcgggcgctgacaccgacgagcgaagccccggcctcactcgaacggccgagcggcttggcgccaggacgcacgtggtcagaggggctggagccgggtgcgcaggaggcagaattcgttgccttctgggtcggccaggacgtgccagctctcggcgccggtctggccgacgtcggcgggcctggcgccgagagcgagcagccgctccagctcggcgtcctggtcgcggtcggtggcgttgacgtcgatgtgcagtgggagcttcccgggccgcgggtcgctgctggcgctgaggacgagggtgggctgcgggccgccgaagccggcgtcgggcggcccgatctggatgcttccgtcgtcctcccggccgagttcgacgtagccgaggaccttgctccagaatgcggcgagccgctcggggtcggcgacgtcgatgaccagctcactgatgcggcatgccatgcccgtcagtgtacgtagacaaaccgcgatcagcccctgcatttacgccagcaccgagttccgcggggtactcccgcagaaacggtgcagtaaccggtcccgcacagcggtcagttcacccgccctcaacctgacatcagcaaggtccccgcccataaccacaccaacgaccgaactgcccaaccgtcatggcaaatacggttgcagtactgggcgccggaccatgatcaagccggcgaggagccatccccccaggtgtcggcgtctcgcgtcgcccaccatctgatggagcaccacgtccggctgctcatcgaactcggcgcctcggacgccgcgcacttgcgcggcatggtccccggacagaaggttctgggcaccgaggtgcgggcctccacccagacctcgccgatcgaggacacggtgcccggcggtgaggaggacaggctggacgatgtcgatggcgcgcgcatcgtgtcccgccgtggattgctgccgcgatccacggcgtacggagcctgttgcccgaacgtgcgatgcgctggtcccgccattgcgtcagaagcgtgtgagcgggcgggggtacggtcttcgacctcaatcgttgcgctgttcgccgcatgatgcgtcgagaccggatcccccctgcccggctgtcactccgtgtcgaagtccgtcccccgggagaccttctcccactcggtgagctcggcccgcacggagtccaggtggccggtcaggaagtcgaccgcgtcgccgccgagggcaaggcggagcggggtcttctcggcgtccagagccagccggatcgccgccgcggccttcgccgggtcgccgggctgactgccgtcgctgccctgcaccagctgccgggtcgggccgactttctccgcgtacgccgggttctcctcggagaagtacgccgcacccttgccgaacaggttggtacggaacgcgccgggctccacgatcagcaccttgatgccgaagggcgccacctcatcggccaagccctccgacagttgctccagcgccgccttggtcgcgctgtacgcggagaacccggcgaaggacagctggccgccgaagctgctgatgttcacgaccgatccgctgccccgctccctcatctgcggcagcagcgcccgggtcagccgcgcggggccaaacacatgcagctcgaacaggtcgcgcagctcccgctcggtggtctcctcaaacgcccctacctgggtgcggccggcgttgttcaccagcacgtccaccctgccgtaacgggccaggacgtcggcggccaccacatcgatccgctcgccgtcggtgacgtccaggctgatcgcctccgcacggtccgggtacgcggcgaccaggtcgtccagcgcctcggtccgccgagccgtgccgatcaccgtgtcaccggcggcgaccgcggcctccgcgatggcccgcccgaaaccgctgctcgcgccggtgaccagccagaccttggcgctctcgctcatcgtcatctccctcgtcaactgccgttcggggcctccccgtcgacaggtcccatccttcggcaggcaccagggcggcgtccaagaccctttgtgatagccatgagttatgaacatccatgggcgcgatctgcgctacttcacctcggtcgccgaggaactgagcttcacccgcgccgccgagcgcctgttcatctcacaacccgcgctgagcaagcagatacggatgctggagaagcaactcggcgcggtcctgttcgaacgggaccggcggacagtgcggttgaccgcggtggggaaagccctgttaccgcacgcccgcgaggtactggccgcctggcaggccgcggaggcggcggtagaggaggtgaagaccgccgagcgatgcactctggtgatcggcatgtccaccagtccgggccgcgggctgctgcccgccctgcggacccgcctggtctcccggcatccggacgcgcagcccgtcctgcgccaggtcaactgggcggatcccagtgccgggttggcggacggatccagcgacgtcgccttcgtctggctgccgctgccggacgatgaccgataccagtatgcggtggtggcccgcgaacctcggctggtcgcgctgccggacggacaccccttggcggcgcgggccgcgtccgaccccgaagggaaggtggacttcaccgacctgctggaggagcccttcctcgccctccctccggaggccggcccgctgcgggactactggctggccctggacgcccgggacggtcgtcagccgcggatcggcggggtggtggccagcgccgaggagacccacgaggcggtcgccagcggccagggggtggcgctgctggccaccggtaacgcctcgctggttgtccgggacgaggtgatcgccgtgccggtccggggcatttccccatcccaactggcggtggccgccggccgggacgacacacggccactggtcctcgcctacctggccgctgcgcgggaggttggggccacaacctgttgattcggcgcctgatgcgtcgtggatctcgccggccctgctctcatcggcagccaccacggcatgcccaggcgccacctggatctggggcaggcccacaccgccaacccgccgattacggcggcgatatatgtacaccgttcgaggaacccagcgccagcaatgggattgcctcaggagcgggcacccgtgcctgactgtgcgaatcccaggcaccggccctgccgcgctccttcatggcagcgcgggaaggggagccaccccggcgttcgcggtgccgcgaacggaccatccgcagacgctcgcgcggcatacagacgtaggtgcccgagccggcacgtccttcgaggaggccctcgatgatcaagccgtccatggccctctgcatgacgttgcgcccgaccccgtacttctcggcgagctttgcccgagacggcaggcgctcccctatcccccactctcccgcgagaatccgtgcacgcagcacgtcggccaatgcaaggtacggcgcctctcggggcataggtgactctccggttgctctgctacgcggcagctgttgattccaggcggcgttggcaaactactgcaccaggtgaaagctactggagtagaaatgcgctcagtccactccagcccttcggctgccaccgctacctccgtgaccgacagtcccggcggtcgcttcggcgccgggaaccaccggtggaacagagtcacccgtgtctcctcggcaagccgtaccgcaacatccgccagcacatccgcgtcgtacgacagccacacctggaaccggtgggtgtgcgggacctccgggttcacccggaaccagggcacccctgccgccccgagcgccttcccgaccacctccgcgtgcgccacgtactccggcagccggggcagctcccgctccagaccgaggagcgcgcgctcaacaccaccgggtactgctggactcaagaggacgccccaagtgcgggggcgctcccacagccgcgtcccgtcgaagtggacgcccgcatcccgctcccgcgcggcctcgaccacggcggtcagctccttccacgtcggcaggacgaacccgggctcgcggggcggcagttcgagcatcagcgtgccgaagggctcctcgaagtggcggacctcgtcggcgtcgagtagccgcggttctgacgtcgggtgcaccggtggcgcgggagaagcgcaggatggtgttgagactcataccgagccgccggctgccgagtggcggacctcttgggcttcgcagcgcaagcacaacgtcacctggtgctgaccgaccgcttcgccgtcacttgaacgaccgacgtcatccggcagtacatcggctgaggtcgacacgggcaggagttcagcccaccggctcatgctcgggtgaggacgacggcgcgccggtccatcggtgcagggtggcttcgaggccggtgacggcagcgttgccggtggtgtcggaggcccaggcgaccaccccgtccgggcgtaccaacaccccggtcggcgtcgcgtggtcgtcggtcacgctgctcacccgcccgtcccaggccgcggcgaggcgggcgaacgcgccttccggagtgcggtcgagcagcaggaacccgccgtcgtgaccgtggtcggccagacgggagccgtccctcagccacaggtcggggacgaaccgcccgaccagcggatggtcgccgagcaggtcgatgcgctggtcgactccggagatcttcttgaccgcgtaggtcgtgcccgcccgagtgctcagcaaatcgccgacgacctcccggagcgcggccgacttggcgtccccgcgcagcaccccgatctgggcccgcgtccagtccagcacccaggcgccaaggggacgacgttcggcgtcgtaggtgtcgagcagcccttcgggtgcccacccggcgaccacggcgccgagcttccagccgaggttcatcgcgtcgccgaccccgagattgagcccctgaccgccgaacggcgggtgcacgtgcgcggcgtcgccggccagcagcacccgccccgaccggtaggtcgcggcctggcgggcgttgtcggtccagcgggtcgcggcaccgcgcagcgcggtcagcgtgacgtcggtgcccgagacccggcgcaaactggtctgcaactcctcgagggtgaccggcgccacgggggtccccccgcgcgagcgaagccgagcgtgggggaggtctgcgggagggccgtcgaactccacggtgaccacccgcccgggctgcggcccgtagcggtacgccccccgggtcgaccacgcccatccgttggcgagcttctccgggtcggcgatgtcgacgaccgccagatgtccggtgagttcggggtcggtgccggggaagtcgatgcccgcgaggcggcgcacggcgctgtgcccgccgtcgcacccgaccagccacccggtgcgcacggcgccggcggcagtgccgacgagcacgccgtcgccggtgtcttcgagcgtggtgacctccactccgcgacgcaccggtacgccgagtcgcgcgacatggtcggcgagcagctcttccagctcacgctgcggcaccaacctcgctccgtcggccgcggtgtgcgcggcgaggtcgggatcggaccagtccacgaggtcggcgtcgaggaccatccccgcgaagtgcccggtgaaccgcgagtcgggcgctcgccggccctcaccgggtgtccggtcgtcgaccatgcgggtgaacgatcccacccgctcgagcatctctcgctgcaccttttcggcggcaggcagcaggccgcggcggtcgagtgcctcggccgtcggcatgttgatcgactgcgccttcatcgcctcgtccggctcggcccgtcgctcgagtacctgcaccgtcgccccggtgagcgccaactccgcggcgagcacgaggcccaccggcccggcgccgaccacggtcacgtccacatcctggttcacattcatgttcacgaacagtgttctatttacgaacggtgttcgtgtcaagttatagtggtcgggtgaacccgagagagcgacgcgcggcgcgccaccagctgccgaaccccgaggccgaagcagcccccaggccgcggcggcgcaaggccccgatcaccgtggaacaggtcatcgacaccgcgctgggcgtcatcgccacagagggatacgaggcactgaccatgcgccgactggcaggcgcgctcgacaccggacccgcctcgctctacgcccacgtggtcaacaaggccgacctcgacgagttgctcatcgggcgactgtgcgccgaactcgtactacccgaacccgaccccgcagcctggcgggagcagatccgcggcgtgtgcacccaggtacgcgaccagtacctgaaataccccggaatctcccgcgccgcgctcgccatggcccccaccgacctcgagaccctgcgcgtcagcgaaggaatgctggcgatcctgctcgccggcggcgtcgccccgcaggccgccgcctgggccatcgacgccctcttgctgtacgtggccgcctactgcctggagatctccatcgcgaagcagcgcagggtccacgacgaggcggactgggtcgtcgacaccgacgagctccagcgccgactggccgcgctgcctgccgagaccttccctcacaccacccgctacgcggccgagctcaccgccggcgagagccacgaccggttcgacttcaccctcgccctgatgatcgacggcctcgcacgccgctagcccgacatcgccttcccacctcggtgggcagatgagcaggacatcggtcgggccccacggtcagacggcccccgatgcgcccggtccctgaggctcggcatcagcatccgtttggaacggacgaacacgccccagccgatgatcgacacgttgaacagctcggtgaacgcgacgactccggagtaaggcaggtcgggtaggagcgcagccagtagagcagcgggaccagcgcgaggtcgacgcctccgatccaggccacgtagcgaaaaggccggtgcacagcgagcgtgaacacggcggccatcgccgccccgcccgaggtgttggacagcagaccgaccgggaccatcgcgacggcgaggccgaccggtcgccggcgccacagccagaccgccgcacagttgtgtggctgattgcttcacgcggtgaccttggcaatgagcgcggcgaggttcgcgacggtccgctggatcttctcatccaaggtgagcgactcgggaagccgcgcaccgacgcccgcatccttcttgccccgcacatacagcgagcaggcgaggtcgctgcatatgtaggcgcccacggagttgccctgctgcccggccttgcccgccttcgcggcgaccatcagcgagacgccgccggtgtgggtggtcatgcacatcgagcacatgctgcgccgcgtctgccaagaagtggcactggggcagcgcaacgcgagcgccaccgggcgtccgtcccgctcggtggcgaggtaggcccggtcgggggcctgggggtcccgccagccgaggaagtccaagtcgtcccagggccgttcggccaggtcgcgggggacggacaggcgcttcgcctcacccttggtgcagttcacgaacgcggtacggatctctggctcggtcagtggcttcataagcagcaggctaatttgcctaaatctattaggcaaatgcatgatggttatcgctagatcggagggaggttatggttcgagcagggctgcccctggagcgcccgacccggccggggaccgaactggccgacgaggtcttggattccctcgacgctctgctgcggtcggtaaccggaccacgccctgacccgccgggagccgcgccgccggagacggtccgccacgcccgcacgcccgcgcaggtactcacgcactcacgcacctgaacaatccggaaatcttgatcaacaggctgggacaatgaacactcaacacgactggatcaccacacctgtcaccgcggacatcctgcgcggattcctcgacgtggaaccgaccgcgcagggcctgctgccgcatcggctgcccgctagggctcgccggcagtccctgacaaccaactggccgtggccgaggcccagccctccggcgtgcggttggccttccgcacccgggccaccaccatcgaactggacacgctgccgaccaagcgggtctaccgaggtttcccggccccggcggacggcgtgtacgacctgctggtggacggccgactcgctgcccaggccacggtggccgacggtaacgtccgcacgattgtcgacatggtcacccagtccaccgaactgcgtgaagggcccgccggtaccgcccggttcaccgatctgccggcgggtggcaaggacatcgagatctggcttccgcatacggagatcaccgagctgatcgccctgcgcaccgatgacccggtcgagccggcgccggacagcgggcgcagggtgtggctgcaccacggcagttccatcagccacggctcgaacgccgcccacccgaccgccatctggccggccctggccgcagcccagggcggagtggagctggtcaacctggggttcggcggcagcgcgctgctcgacccgttcaccgcccgggcgatgcgggacacccccgcggacctgatcagcctcaaaatcggcatcaatctcgtcaacaccgacgcgatgcgcctgcgcgccctcacccccgcagtccacggtttcctcgacaccatccgcgaggggcatccgaccacgccgctgctggtcgtgtcccccatcctgtgcccggtccaggaggacacccccggccccctcgcacccgacttcgacggcgggaccctgcggttcaaggccacgggcgatcctgccgaacgcgccgccgggcgcctgacgctcaacgtcatccgcgacgaactcgcccggatcgtcgaacagcggacggctgacgacccgaacctgcactacctcgacggccgtgacctttacggcgagaaggactacgccgaattcccgctgcccgacgaggtccatcctgatccctcgggacaccgccgcatcggcgagaatttcgcgcggctcgcgttcggcgacggcggccccttcgccgccgaggccgactgatcacatcgcggtcacgcagacggcgttcgctacctggccgtagggacagcctcggcctgaacctctaccaggtcgcccgcgaaccgttgttactcctcgcgttctggaccagcgcctgccctgcctgttaccgcaacgcctgttaccgcaacacgccagacctccgagcaggagaggacggagagcaagcttggacatcaacctcagcgccgtgatcctcgggccgccgagctggagtccgagatgcgttctggcaccggctgctgggcggctcgatcgcgaagaccggacatcgcccgcctctcggcgttcgtacggcatcacatcaccatgcacggccggtactccctccagctccccgacctgcccggcggcctgcggcccctgcgcgaccaggacgcccccgacgacgaatgacgtggcgccctggccccgcaccgccgggcgggagcaacctgggacacatggccaggaccacggcagggcctgagcagtcaccgaatcggcacgctgcttgtcagcactgcaaagagtggcagagatgatggcaccggccatccgccatccgccatccgccatccgccatccgccggcactcaacccgccagctctccaaggagtgcccaggtacggcgccggtcggagtctccggcgatttccgtgcccgagaacaccacctccgtcgccccggcgtcccggtagcgccgcacctcggcggcaaccctcctctcgtcaccgatcacggacacatcggcagcccgttgaccgccggagagttcgatgacccgtgcataggacgggatctgctcgtagaacgcgagctgttcgacggccttttcgcgtacggagtcggcatcgtcagtgaccacaccgtgcaccatcgcgacgatcctgggcgcggggcggcctgcggcctctgccgctgcggtgacggccgggacgatgtgttcgtccagggcacgcgggccggccagatagggcaggatcccgtccgccagctcaccactggcacgcagcgcctgcgggcccatcgcggcgacgagcagcggcacgccgccctcggcgcccggcacacgcgcggagatcggcgtagccgcggtgagcagctcgccgtggaagtcggcggcgccggtctcggtcaactgccgtagtgcggtgaggaattcacgcaggcgcgcgatgggccgttcgaagggaatgccgaaacccgcctcagtcagaagcttggtgccgagcgccagtccgagatggtagcggccgtgcgtggccgcctgggcggtctgggcctggctggagacgagcagcgggtggcggccgaacacagggatcgcggacgtacccacgtgcagaccgggcacttcccgccccacgaccgccgcgagctgaggtgagtcggcgccgaaggtctgcccgaaccaggcggaccgcagccccgccgctgcggcctcgtgagcaagccgcactgtggcgtcgatctggttgtcggcgtcggtcgcgttgagcgctactcctatagccatgtcagcgcaaaccagcggcggccagccgcgcattccggttcttgtgtgacggctccttgtcagttgtgtgtacgcggccggtcagttgtacgtacgcggccgccatgcgcgtccggcccaccgacccgctgatcttggtgacaggaagcctgccctcgtggcaactgccgtgcttcaccacaagaagccacaacggcacccggcccaccgcccctgagcagggtgcttgatactcaacaggcccgactcaccgcgccgcggcgccgccaggggcgaagccaagcctcgtgcggcccccgcgcgagatccaaggacgactacggtggccggcccgcacagcacaacccgcacccccggccaccagcaccctcccgaccacccgacctaaggaacgcacatgacccagatgcccggcacggccagatgcgctcgcgccatcctcgtcgtcgtgggcacagtgaacgccgccaccgtcgcatggctgacggcagccgccgccacgctcgagaccggcgccctgggcgagctggtcctgggcatcctgctcctcgccgcaatcgtgtctgcggcactcgccatcgcctcgttcaccatcgcggcgaaattcacccacggcagcagcaagacccgcaccggcgcggccgccgtcggctggatcaccatcctcgccggcaccatcgcccttctgaccgaccaccccatgggggccgccggcgccgcagcgggcacactcctcacagccctctccaccagaaccggcaccagagactggttcgaccgcccacgcctcccccgaccaccccgcaacgcaaaccactgaaccgccggttatcccggcatgtcggtcccggtcgtgaccgatccgcggaccatgaccgccggtcgtgaacctcgtcgaccctcacggtgacacgttcggtgccggccacgtccaggacgccgggtacaggcacccgtgacatccaggccagcgacggtggtcgtcgctagctgaggcgggaccggcggggcgaagccgatcgcttcgtcgtacttctggcgggtcgtcatcacgcagtggtggagctggccgagcagacggttgagcaggtggcggacgaccacccggctttgcagacgagggtgtcagcagacgacggtgagcgagaacggccggtcgctgtccacggcggcgctgccgccggcggacggcgtcgcggtgcggatgtagagcgtgttgggccccccttgccgaccaggatggacgagctgcccgggccggggtcggtgccgttgttggtattgatcgtgcccagaagggcgcagtcggcgaggttgccgtagatgtccagggcgtagcggccggtgccgagcttccggatcgccgagatgcccgacccgcccaggagcacaccgtccgcgcggaccttggcccaggcggtcggggccgccgcggcgtgagacacctcccgcgtctcggcggacgcggacgacaccgcgaccgcggccccgatcgtgagggccatcaccgcggccccgaggaccagcttccttgatccgttcgtggttctctccctgccgaagaatgaatcggagcaggtggccctccccgggtaagggctcaccggggaggactctcctccctccccgaccggcagcagaaggcctcgcggcgagagtcaccccaaatgatcgagctgccctatgcgcacattcactcgaaagagcattgtcgtctcccatctgtcagcgaaaggcatgatgaggcgagacgaagcccccaccagccggaaccgaccgcccagcctaggaccccgccgggccgggctcctactgctgttgctgatcctgctgctggtcttgttgctgctggtcctgctgttgctgatcctgctgttgctgatcctgctgttgctgatcctgctgctggtcctgctgctggtcctgctgctggtcctgctgctgccctgttccggcaggcgcggacccgtcattctgcggcgccacactctcaggcgcagaagtctcgggctcgacctgcgaggaaggctccgcgggagtcggcgcctggggcattgaggactcgccggccgagggcggtggcgccggctccgacgacccctccgaagccgactcgggagaagacggctcgcccgagtccggtggaggggtgccctccgacggcgtcgactccctgcccgactcagacgaccccgactccgactccttatccgactccttatccggcttcgactccttatccggcttcgacgaggacggcttacccggttccgacggcttcgacgacttcgactccttgtccggcttcgacgacttgtccggcttcgacgactccgactccggggacttcgactccttgtccgacttcgacgactccgactccgacttcccgcccgactccgacgggttcgacgacttcgactccttgtccggcttcgacgacttgtccggcttcgacgactccgactccggcggcttcgactccttgcccggctcggacgactgcgactccctgcccgactccggcggccgctgcaccggcggcgccgtcttcttgtcgtgcgtgccccgctcgtcgccctgctcccgggtgaaccagtcccccttctcagggcccgccaccacaaacttcttcaccgcatggggcgcaggcgcgacaacgacagcacccgagggccggtatccgggccacgcatgacccacccgcttgggcgtgcccttctgctcggccggcggcgtcagcgggttcccgcacgcacagcgcacccgcggcacaccacggtcatcgaccaggaccgcagtgcccgcctgcagcacagcttgatagctggtggcagagccattgcggtaaccatgattggtcacccgggtatccactctgagatgcaccggagtcagggcccgcagatagtcgggaacatcagaaggccctatgttcaacgccgcggcaaacgccctgttcttcgacggctccgccttcagcgcagtgatctgcttccccacatcacaactggcgacattacgtgtcccgccgtacagacccggagcatcaccatccacactccgcgacacatcactctccgccgaaccaggcagcacaggcatcaccggcggcgaagcatcctcccgcaccgtcgactccgtaaacggatccacccccctgctccccgcagactgcaggaagacctcaccccgctgttgatccggggtaccaccggatcgtgtgaacacaacaaccagcgccaccacagccaccaccgcagtgacgatcaccgccacccgcggcaccgactcccaccacctgtcccgcccctccccaccaccacccgcaccgcccgacggcccaccacccccgccaccacccgacgccccaccaccacccggaggcagaggcccgtactccggctgagaaggagacgccaacggacccgacggaggacccgacggcctcccagaaacacccgacgcacccgaggaatgaccagacccaccatcagacggacccgaagaaccaccagacgacgacggacccgaagaacggccagacgcgcccgaagaacgatcagacgacgacggttccacactcacgagctctacatcccgcatcaggacctgcagcgcacaggccaaccacacacagccaccgggaaacccgccaccacacccgccgaccaaccgacaaccccacccacacgggaaacccgaccgacaggcaaaccagcagcacaagccgagacacagccacccaccaccagccccacaccatcacactcacaccaccaacccccccccacaccaccattgtgcgcaaccaccccgcacaccccgcaagccagaaaacaacccgcctcaaagagcgagcggtgaaaccccgccacaaccagcccgggacctccgacgaaatggcttactcctgagatggcaagtgcgtagccagggcagctgatagggcaccgtcgtgcggacaggggaccccggagggtagggcaccgatcacgccgggtctccgaagggaaagatgccgaacacatccggccgggaaacgacgctcatgcctgctgccgccccggacctggcagcccgacgatcaatccgatgaacccgctcaatgagccgctcgggccaggctcgctctactcaaagcaccggctcgtcaaaggaccggctcgccgatgccgagcatgttcccctcactgtcacaaaaccaggcaccgcgttcaccccgcgcgcccttgctcggatagttcccttcgatctccgcgacttggcccctcgttcgaaacccgggcacgtcgacctcctcgaataccacaccgcgccgtctgagttccgtcatgactgcctcgatgtcgtcgacttcccacgccatctgagtgaaggtgccgggcgaggagcccgtcgactggaacaccacgaagtccgcgcctgagcaccgatacagcagcccaccaggccgttcgtcgaccggctccagaccaagctgctcacggtagaagcgccgcgcccgctccaagtcctgggccggcagcctggtcgctacgcgtgccccggccagaaggctcctgtcatctgcgttcatggccccactgtgccgggagcagcagccgcgcaggcaatggcaacagccacatgccgccatccgggcatggcggcctcacccgaccggacgggacctcaccggcgcggacggccaaagaccggccgggcccacaaaggcggctccgggggcggcccggagtgctgcccggcagcaagaacctcggcatccacctgggtctgtggatgcgatccctgaacggcaccgctcgcagcgacacgcaaagccgccacaaactccagacacgagccgtaacggtcctcgggaaccttcgccagcgccttcgccagaacggcgtccatcgccggcggagtccccggccgcttctcgctcagagcaggcggggagtcgtactgatgcgcccacagcaacgctatatcttcatcccgctggaaaggcggcccacccgcaagggtttcgtagacgacgcaggcaagactgtacagatcgcatctgccgtccaccggacgtcccgaaatctgctccggcgccacataatcaagcgtgccgacaaattcacccaccgtcgtgaacccggtcagcgacagcgacttcttcgtcaagccgaaatccgtgagataaacatgctcaggatgatcactgtccgttccctgagcaaccagaatattgccgggcttgacatcccggtgcaccaaatcatgttcatgagccgcatcaagagccgacgccacctgagcagcgatacgcaacgcagtcaccaccggcaacggaccatcccggtcaagcagagcacgcagatccagccccgatacatatcgcatcgcgatatacagaacaccatccatctcaccggcctcaaaaatcggcacgatatgaggatgatcaatcgcagcagccacccgtgactcatgcgtgaaacgccgccggaaaatgtcattacgcgccatctccggagccagcagcttcaacgcgaccatacgatccagacgcaagtcccgggcacaatacacaacggccatgcctccacggccgatctcacgctccacccggtaactggcaatctgcgtccccaccagacctgcagcccggcccgcatacacacccagcccatccgacgccgtacccatcacacgtcaccgtcacccaaccccgccgcggccacccgggccctcgccccaccaccggaacccgcctcgaaggcacatcccggcacatccaaaccgacaaaccgcccacccatactcaaatactatccagccaccctcgcagccgccccaccaagatccccccctgcccccaccacccactccgggccgtggctaggccgagccgtcttcacgccaggcttccgggccggctgccccttcgcccgagagggccgcgtccgtagcagccgacgccacgccaggctcctcgatgacctccggcagcgcctgttcggcccagatcaccttgccctggggggtgtaccgggtgccccagcgctcggacatctgcgacaccagaaacaggccccgacctccctcgtccatcgtcgcggcgtaccgcagatgcggcgatgtgctgctgccgtcggcaacctcgcaggtcagcgtacggtcacggatcagccgcacatggatcggctcggaaccgtagcggatggcgttggtgatgagctcgctcaggacgagctccatgctgaagccgagctcggacaggccccactcgtcgagcttttgggacatggcgtcgcgcatccccgcgacggcggccgggtcgagcggcacatcccagtcggcgatccggtcggccggcaggccccgggtgcgggcgatgacgagggcgacgtcatccttggggcgcccgggcagcagctcgtccagcacagcctggcagctctcctcgggcggccggtcagggtgacccgccagcgcatcgcgcagcagttccattcccacgtccaggtcgcgcttgcggtcctcgatgaggccgtcggtgtagaggaccagctcggcgccctccgggaggtccagctcggcggtcaggaacggcatgccaccgaggccgaggggaggcccggtcggcaggtccacgaaggtgacggtgccgtcggggtggacgagcgcgggcggcaggtgccccgcactcgccatgacgcagcggcgcgtcacggggtcgtagatcgtatacaggcaggtggcgcccacgacacccgcggcactctccgtacccgcctcgtcctggtcgatgcggccgaccaggtcgtccacatggctcagcagctcgtcagggggaagatcgagtgtggagaagttgtgcaccgcggtcctcagccgccccatcgtggcggctgcgtggaggccgtggccgaccacatcgccgacggccagcgccacccgactccccggcaggggaatcacatcgaaccagtctccgctcacgcccgactgggcggggaggtagcggtagccgacgtcgagggcgctcacctcgggcagggccctgggcagcaagctgcgctgaagggtgaccgccagggcgtgttcacgggtatagcggcgagcgttgtcgatgctgaccgcggcgcgggccaccagctcctccgccagcgacatctcctcctcgacgaagggctcgtgctgcttggagcgccagaagttggccatgcccagcacgacgccgcgggcctggatcggggcggcgatgagggaatggatgccgtagtcgatgatcgccttggtgcgctccgggtcctgcgcgtgccagcccgtggcggtcgacaggtcggtcaccaactcggagtagccactgccgtagccgcgcgcctggggcgtggaaggcagaaagtcgatcagctgacccagttcgtagagcggatggtcgtcccggataccgcacacggccgtgcggcggaggtccgttgccgtgggggccggctcctcgccgtgcagcacggcgtcggccaggtccacggtgacgaagtcggcgaagcgaggaacggcgacctgtgccagctcgtcggcggtgcgcagcacgtccagggtggtgccgatgccgagtccggcgtcgtacagcagcttgagccgctcccctgcgatctccgcccttccggtcaccgcctgcaactcggtggagtcgcgcagtgtcaccaccgtccccttggggcctccgtcgcgatccgtgggccgctggttgacggccagcagccgttctccgacaaagtgcacctcgtcggtggcttcgcggcccgagacgagcagcgccaatgtgtcggggtcgaggctcgacagctccgacacgagccgtccctcgacgtccgggggcagctccagcagccgtctggcctcgtcgttcgccagcaccagccgcccgtcgccggcgacgatgaccaccccttcgcgcacggagtgcagcaccgcgtcgtggtgctcgtacatgcgggccatctcgtccggggccaggctgtgagtctgccgtcgcagccgcctgcccatcagcgctgtcccgccggtggccaccgcgagcgccccggctccggcacccaggatgatcggtagttgccgggccacctgattggtcacgctcttgaccttcagcccggcggagacgaggcccaccaccttgccgttggtgttctcgacagggacggtggcctgtacctcgcggccgagcgggccgttgacgctttccgtgtagaccttcccctccagcgacggcccgatgttgcccacgaaccgctttccgattcggctcggcacggggtgcgtgtagcggatgcccttggtgtccatgaccacgatgaagtcgacgccggcggccttgcgccccgcctccgtgagcggctggagaatcttggtcgggtcggggctctgcaacgccgccaggacaccgggagagtgcgcgaaggtctgcgctacggctacggagcggcgcttggcctcggcatctgtgtcccgcttcgactgcagggcgacggccaacacgccgcaggccacgagcagcactaccagagccacctggaggaccaacacctgcccggctacgctgcgcgggctcctgctgaccagtgaccgtgacgaaagacgtcgaaaacgggcgaaacggctcgccatgcgacctttctagcactggtgatcccgagtggccagggcccgcccgaggagtgacactcacctggctgctctcctgccccgttaagccacaccagactcgatggcccgcacggccacagcgacaccgactgcaccggcggccacagcaagtcggagcaggtcgggagccgccgcggggcgcggcgtgtgcccacgttgccgcgctcagatcaccccgcccagcgcggctgtcgcgaggcgctgcgcaagcgtggcgccgacgcaagtgaagccgtcaactactcaggcatttactgaagggatgtccgccggtcccgactcatgaatctccccggaccgtcctcggcacaggaacagcagagatcgccgagtctgccccgccgcacccgtcagtcggggccggcttctgcgggcgtgtgcgcggtggggcggtgcggcctccgcaatgtccgccggagcgtttcgaaggcggtggggcgtggccggtccggcagaaagtcacggatgcgaagggcgcattccgccggggtgtggaggctgctgtcgatgtcgaggtcatgcagctcgtgggagtgcaccgcgccgtactgcatcgcggccagtcccggctgccggtcaccgcgctcgctctcgcggcgctccagctcgggcagcggacagcggaccccgaccaggactgtgtcttcgggtacgagcaagtcgaggaggtccagcagtctccagcgtcggctgagcggatagtcgacgacgaggttgttgccgcccgcggccataccggcgaccgcgcggtgaaaccccttggcggtgcggtcgatctcaggctggagttcctcatcggatatgtcgcgtttgcagcgcatggcgtggaacgcgtccactggcatgtggaaccacgtcccgtccaggatgtcgaggagtgcgcgggccatgctggtcttgccggagctggacgtgccgttgagcaagatgaccatgcctgcggctgtggtgtcggggatcctcgcgtggaccaggtccgcggtgcccggaaccgcctcgatcgccatggtgccttccttccgcctgtcccccagcgcaaggcttgagccgggtgtgccaccgtcccgatcatcgcaggcgccctgtccgtcgcgttccatgtcacggctacggcgacgggcgcgggcatcgggcatcgggcaggccagctggtcggcccgcagaggatgtgcccccgttcgcgttcgaacgcggcaccagggtgctgccgacgcacgcctcccgcctgtggcccgtcgccgtccatgtggcccatcgccccaggccacccgactcgcgtggatcggtcggaccgtcgggcgtaccagcgcaatgccccgggctccggcgaggggtgcccggggctggtgctgttgctggtgcgggagggcaccggcggtcccggccaggtactcctcgttatccgaactggccgggctggtagtcgccggcgggctgctggacgatgacgttcacgcggttgtaggcgttgatgagggcgatgagggacaccagggcggcgagctggtcctcgtcgtagtgcttggcggcattcgcccaagcctcgtccgtgacaccgccggccgcgtcggcgatgcgggtgccctgctccgtcagctccagggcagcgcgctcggcgtcggtgaacaccgtggcctcccgccaggccgcgatcaggttgaggcgcgtcgaggtctccccggcgtgcgtggcgtctttggtgtgcatgtcggtgcagaaaccgcagccattgatctgactggcgcggatcttcaccagttcctgcgtcgcggccggcagcgtcgagtccgagaccgccttgcctgccgagttgatgtacctcaggaacttggctccgaccgggttgccgaagaggttcaagcgagcgtccatgatgaactcctatgccttgctggtggttacacctccctgacggaacagctcggcaagatgtgacaggaacgcaggaacgaacgaatgtgacgtgcgtctcccctcccgcacagcggcaacggcagcggcggcggcgacagctcccgtggtgcaccgttcacgttgcggtgcagaaggcgcgcgggggacgtggggcggcgtaccggacgccgccgtggaacccgtcgcccgccccggcgcggggccggggcgggcgacgggttcccggatgtcagagcgatgtcatgacgtgcttgatccgggtgtagtcctcgaagccgtacgcggagaggtccttgccgtagccggacttcttgaacccgccgtgcggcatctcggcgacgagtgccatgtgggtgttgatccatacgcagccgaagtcgaggttcttcgacatccgcatcgcccgtgcgtggtccttggtccacaccgaggaggccagtgcgtagtcgacgccgttggcgtactgcacggcctgggcctcgtccgtgaacgactggacggtcatgaccgggccgaagacctcgttctggacgatctcgtcgtcctgccgcaggccggagaccacggtcggggcgtagaagtagcccttctcgccgacccggtggccgcccgcctcgatcgtcgcgtgctcgggtaggcgctcgatgaagccgctgacctgggcgagctggcccgcgttgttgagcggtccgtacagcacgtcctcgtcgtccggctgcccggtcttcgtgtcggccgcggccttggcgagggcggcgacgaactcgtcgtggaccgactcgtggaccaggacgcgggtcgccgccgtgcagtcctgaccggcgttgaagaagccgccgaccacgaggtcctcgaccgccttcgccaggtcggcgtcctcgaagaccaccgccggggccttgccgccgagctccaggtggacccgcttgacgtccttggccgcgctctgggcgacctggatgccggcgcgtaccgaaccggtgatggaggccatcgccggggtcgggtgctccaccatcaggcggccggtctcacggtcgccgcagaccacgttgaagattccgcggggcaggcccagctcctccaggacaccgccgatgatctcggcgatcagcacggtggaggccggggtggtgtccgagggcttgaggaccaccgcgttgcccgccgcgagcgccggggcgaacttccacaccgccatcagcagggggtagttccacggcgcgacctgtgcgcacaccccgaccggttcgcggcggatgatcgaggtcatgccctccatgtactcgccggccgatcggccttcgagcatccgcgccgcgcccgcgaagaagcggacctggtcgatggcgggggcgagttcctcgctgcgggtgaggtggagcggcttgccggtgtcgcggctctccgcggcgaccagctcgtcggcccgtgcctccatggcgtcggcgatcttcagcagcgtgcgctgccgcacggagggcgtggcgtcgcgccagacggggaacgccgcggcggcggccgccatcgccgcgtcgacgtccgccgccccggagagcggggaggtcgcgtagacgtcaccggtggtggggtccaccacatcgagcgtgcggccgtccgaggcgtccgcgaatgcaccgtcgatgtagttgcggaacgtgctgctcatggaacgtctctcctggtcaggcggcggtacgggcggacaggtgctcgtggactgcggtccagcggccgtcgtcggcgcgggcgaagacgatggtctcccgctcgtggaccgtctcctcgccggcgtcggtggcgacccgggtctccacgtcgtggctgaagacggccgtgtcgccgaagtgctggatcagctgtgcggacgaggtgcagccgaggatgcggaagccgtcctgctccacccactgctgccagagcgcgcggtactcggccgtggagccgaggcgctccggggtggtgtggaagacgaaggtcgcgtccggggcgaaggcgccgaagtagtcgtcgaggcggccctcggcgaaggcggcgacgagcgcgtccgcggcgtcctggatttcccggacggtggtggtgctcatgcacagctcctggtcacgggcgttcgacgggcggggccggaacgcccggcgttcggttgcgggggtgtcggcgagggctcagtgggccgcggcgggctcggtgacgggctcctcggtgccaccggtgatcggcggcaccgcggcgtccgacgcccggacgaagcgggggccggccggtccgtacacggcgcgcggctcggggaacagggcgagcagggcgaggtagagcacggtcgcgagggcgaggccgaccggcagcgagatgtccgcgccgttcgcgaggttgccgagcgggccgacgaactggccgggcaggttggtgaagaggagcgccacgacggcggagacgagccaggtggacatgccgcgccagttccagccgtgcgtgaaccagtagcggccgccgcgctggcggcggttgaagacctgcagcgcctccgcgtcgtaccagccgcgccgggtgacatagccgagcgccatgacgatcatccacggtgcggtgcaggtgatgatcagcgtggcgaaggtggagatggactgcgcgaggttcagcgcgaagcggccgacgaagatgaacgcgatggacagggcgccgatgaagaaggtggcctggacgcggctgaagcgcgtgaagacgctggagaagtcgagacccgtgccgtacagggccgtcgtgccggtggagaggccgccgatcagggcgatcagacagagcggcaggaagtaccagccgggcgagatcgcgaggagtccgcccacgtagttgggggcggccgggtcgacgtacttcgcggccttcgacgcgatgatcgacgcggtggccaggccgaagaggaacggcagcagggtggcgatctgggcgaggaacgcggctcccatcacccggcggcgcggggacccggccggaatgtagcgggaccagtcaccgaggaacgcgccgaaggagaccgggttggagagcacgatcagcgcggcgccgatgaacgacggccagaacagcgggtcggcggtggaggcgaaggctcccgcgtaaccggggtcgaagtcgcccgcgaaggcgaaggcaccgagcacgaagagggccgacgccgccagcaccgcgatcttgttgaccagcagcatgaaccggaaaccgtagatgcagacggccagtacgagcccggcgaagatcgcgtacgcgatgccgtaggtgacgtccgactcggggacgtcgacgagccggtgtgcgccgccgacgagcgcgtcgcccgaggaccacaccgagatcgagaagaacgcgatggcggtgagcagggagaggaacgagccgacgacccggccgtgcacgcccaggtgcgcggaggaggagacggcgttgttcgtaccgttggcggggccgaacagggccatcggggccagcagcagcgcacccgcgacgaggccgaggacggtcgccgcgagtccctgccagaaggagaggccgaagaggatcgggaaggcgcccagcacacaggtcgcgaaggtgttggcgccgccgaaggcgaggcggaacagatcgatcgggcgggccgtgcggtcctcgtccgggatccgctcgacaccataggtctcgatttcggtgatcgaggtcgtcacgggcgctccaccttccgttcatgcatgggcacggttccacagtgtgtggccctcgcatgtccagcgacaattgtgccaatcacagagccgtacgctgtcttatgtggccagaaacaaactcactgtcgaagatctgctctccttcccggcactccagctctccgtgaaggccggcagcgacggtctgggccggtccgtgtcctgggcgcacgccagcgagctcgccgatccgacgccctggctcctgggcgccgaggtgatcatgacgacaggtctggcggtcccccgtaccgcggccggacagcgcgcctatctggagcggctggacgacgccggcgtatccgctctcgcgctctccgcgcagctgcacatgcccccgctccacgacgcgttcttccgggcggcggaggagcggggcttcccggtcctcgaagtgccgctcgccgtcccgttcatcgctgtcgcccaggaggtcgcggcctcggtccaggaggacgcccggcaccggctgggcgcgcagctccaggtcttcggctcgctgcgctggctggtcgccgagaacctcgacacgcccgcacttctgcgccgcctcgaagccctgtcgggttacgacgtctacctctgcacaccgcagggacgcccgctcctgcccggcgttcccacaccggatcccggtgtcctgcccgcttccgtcgacgctccgccgaccgtccccggcggattcgtcctcccggtgcccgcgcccggcggccccgcgggctttctcgtcgcgtacgagcgtcagggcgcccagcccgcggggctcgccgtcgtccagcacatcgccaccgtggcggcgctgcggctggcgatggtgcgcaacgagcgcgagacgctgcgccgcgagggcgcggagacgctggccgagctgttgcaggaggtgctcgacccggagacggcgcgccgccggctcgcccggcacgcgatcgagggcgacaccgtgctcctcgtggtgcgccacaccaccgacgaggcgctgctgcgctgtctggaggaccatccccatctgctgctcacctggggcgaggaccgctacgtcctgggggcgccggagctggcggtggccgtcggtgagctgccggtcgtggcagccgggatgagccgccccttcctgccgggcgccgcactgaaggtcgcccagcgcgaggcactctgggcggtctccaaggccgtggagtcgggccgtcccgtcgtccggtacggcgacgactcgacgggccggtggctgcccgacgaccccgctgtcctgaccgcactggtcgagcatgtgctcggcgaggtcctgcgctacgacgagacccacgactcgcagttgctggtctccgcccgcacctggatggagcgcgaccgccgtaccgagacggccgcggcggcgctccacatccacccgaacaccctcgcctaccggctgcgccgcttcggcacgctcgcccaccgtgacctgacgtcgacgggggccctggccgaggtctggctggcgatccaggcagcgggggcgctgggcctcaccgactaggacggcgccctacccctacatggggatatgcggaaaatggatcactatcccggtttgccccttttctggcccggcaaaagagagaatcatcgcccttgagcgggccgaaggccggccccccgcatcaagaggagaatccgcgcacctcgccccccagagcctgaccgcgtgtaccccaacccgccactttccggcgcgcggcaggtcatcgttggcaccgcgccctggtcgcgggcggagcccacgacaccgaccgggcattcggtgcagaaagcgaacccatcatgcgagtgaccgctcagcgactccgggccacttccggtccacgtgatacggctaccaccccgacatccttttccgccgccgacgccggcatccttctgctccgactcgccgtgggtctgctgctggccggccatggcgcccagaaactcttcggaatcttcggcggcccagggctcagcgcgaccggcaagggtttcgcggacatgggctaccgtcccggggacttcttcgccggcctcgccggcgcttcggagttcctcggcggcctcggtctggccgtcggcctgctcacgccgctggccgcggcggccgtggtcggagtgatgatcaacgccatggccacgacggcaccaaagggcctgtgggcagagaagggcggcttggagtatccgctgtgcctggcggtggccgccatcgccatcgccgccgtgggccccggcctcctgtcgctcgaccgcccgttccgctggcgccacggaggatgggggccggccgccgtggccctgttcctcggcggcataggcgccgccatcgtgctggccttgaaggcgtgagcacctgccccccagcgcgggcgccgtacaggtgcggtacggccggcgtctgcgtgccgccccccatccaccgctacggctaaccccaggcgccgctgaacgattcccggctcaaggcccgcggcggcgcaccttttacggtgctgggcggggctatacaggacgaaagtgtgcgatttggagtcgcggcggaccatgcccgaccatgggccccgtcccggcggtcccgggcatcagttcgatgagaggcgcacgaccccatgcacgtcaccggaaccgtcccacagtcggctccggccccccaggagaccgtcgcggcccccacaccggccgaagactccaccggcgccactagcaggcacacccgccgcttcgggctacccgtcgccaccgccctggtcatgggcaacatcatcggcggcggaatcttcctgctcccggcctccgtcgcaccgtacggcacggtcagcctggtcgccttcggcgtcctgaccgtcggcgccatcgccctcgctctggtcttcggccggctcgccgaacgtgacccgcgcaccggcgggccctacgtctacgcccgcgaggccttcggtgacttcgccggcttcctcgccgcctgggcgtactggatcaccacctgggtgtcgaacgcggcgctcgccgtcgccgccgtcggctacctcgacgtgctgatcccggtgaacgaccaccgctggaccgcctgcctggccgcgctcaccctgcagtggctgcccgcgctcgccaacttcgcgggcacccgctacgtgggcgccgtccagatcgtctccaccgtgctgaagttcgtgccgctgctgctcgtcgcggtcggcgggctgttcttcttcgacccggacaacctcggcccgttccacgcgagcggcggcagcgtgcccggcgcggtgtccgcctgtgccgcgctcctgctcttctcctacctcggcgtggagtccgccgccgtcagcgcgggagaggtcaagaacgcccggcgcaatgtgggacgagccaccatcatcggcaccacgggcgcggcgctcgtctatctgctgggcacgctgtccgtcttcggcacggtcgcgcacgaccgcctggtgcagtccaccgcgcccttctcggacgccgtgaacgccatgttcggcggcacctggggcggctgggccgtagcgctcgccgcgctcgtgtcgatgaccggctgcctcaacggctggacgctgctgagcgcccagaccccgtacgcggcggcgcgggacggcttgttccccgccgccttcgcgcgacggcggcggggcgtaccgaccgtcggcgtcggcgtcaccgtcgtcctcgcctcgctgctcaccgtctacaactacacgtcgggctcggccaaggtcttcgagatcctggtcctcgtcaccacgttcaccgcgaccgtgccgtacctgctggccaccgccgcgcagatcttccacctcctctcggggcggcgggagctggtcgaccggacgcggctggtacgggacgccgtggtcacggcggtcgcggccgccttctcgatgtggctcgtcgcgggcgccgggtacgcggcggtgtaccagggcgtgctgttcctgttcgcgggggtcatcgtttacgcggtactggcggcccggcggcagagggcggcctgatccgacggcggccggagccgccgtcggtgcgcggcgcttccgctgcgctcacgccaccgtgaggagcgtcgccgtgaggagcgtcgccggccacccaggtcggtcgcgttatcggggcgtcgacacacagaactcatggccgtcgggatcggccatcaccacccagctgacctcgccctgaccgatgtcgattcgagtcgccccgagggagacgagacggtcgacctccgcttgctgatcaccctggacaggtggagcgaggtcgaaatgcagccggctcttcccggtcttcggcatcagtggcgggccgccccacgtgatcttcggaccgccgtgcggcgagcggatcgcggtctcctggtcctggtcccagaccagcggccagcccagcgcttggctccagaagtacccggcgtcctgcgaaccgtcgcacgcaagcgctccgatgaatccgcagtcagcaaggaagttgttgcccggctcgatgacgcagaactcattgccttcggggtcggcgagcaccacatgaccctcctccgggcgttggccgatgtcgatgtgccgggcgccgagtccgagcgacctctccacaacctgctgctggtcatcaagggacgtgctcgtcagatcgaagtgcatctggttctggcctgtcttctgctcccgggtcgaaagaaaccggatccggaacccagtgtcgtcgctcggcaggagcgcgatgccgtcgtaggagtcgtcggccatctcccagcccaggacgcccgcccagaagcgcgcgagacggagcgggtcgttcgcatcgaagcagagcgcgtggaggtgggaagtcatccctcggcatctccgatctactgactgacagcaagaaggctttcatccaggtcgtggctggagcctgcccagacggcgccacccggtcaactcattaacaatccgcgctcaaccgctgacgtcacaacatcgccctcgtccaccaagtcacaggctcgcgaggagatcgtcgagcggggccggtacctgttcggggtcgagggcctcgacgaggaggcggccgtagcggatcttgcggcctctcttcgtgccgaggaagcgccgcaactgctgctgccggggccgaccgtggtgtgcgggctggcgcatgaaggtctgccaggaacgaaagtcgccctcggcccggaggatctcctcgacccttgccgtgcccagcgcgcggatgagctcgtcctccaggtccgtcacgcacacgaagaagccccggcgcggcgcccgtgcccgcttcaggccccggtcgtagaagcgctgttcgccctcgtcgcacagtcctgtcaggcgcaggccgaggccgggcggaccgaggaggccggcgtagcggccgacgctcatcgccccgcccatcggcacgacgcacaccccttcggcggccaggtcccggccacgccgggcggccagcgcctcaacggccgcgaggtcactcagtccttccagcagcaccgccgtccgcacgcccagccgcacagccagatcactcgccggcccctcgggaccgccggtcgcccagccactgaccgcgtcccggaacgcccgcatctccgccatggagcgagtctgcacctccaccgacgacacggcacgggattattcgacggcccccgctcgacacgacccgcgccctcgtcaccggggcagccatcaccctggaaatccgtcactaacaacagagatcaacacggtcgacctttgaacaccaggtgcggaaagagtgttttgcccccccttgcccctgcgttccgcccgccaggcggtcagggcggcctcgatatcggtcgtccgccgcagcacgacccgcgcgggctcatggacgccatcctgtatgtcgaccggaccgggatcccctggcgccacctgccgcgcgacttcgcgccgcgggaaaccgtctacgggcacttcgccgcctggcaaaaggacggcatcttcaaccaactgaacggtcctctaagccagttggagcgggaggccgcaggccgggacgtcgagccccaattccgtgccccccaattccgtgcccctggttccgtaccccctggttccatgcggtctgctgccgagatgaacgagcagatccgggcaccctggctgcgcgcgggcggaacccgccgtgcggtcaggcgatggcgtgactgagccagagatccagtagcgggcggctgcccaggaccgtcatgcgcggcttctccggccgcagccggcccttgaccaccagcagcaggtccgagggcgcggcgaccacggtggcatcggccacgctggtggtcgggagattccgggtgacctgcacgccgtccggcgcacaggtgatcagccaactggagaacccgcccgccggctcctccgccgaccggaagcacagcgtctggcctccgcgcggcacctcggagaacagcggggaaaggaacttcctggcatcgggatccccacaggcgctcaggaaggcgtccacgaggtgcaaggcgacttccgtgtccagctcgaacggcaggccggccatcaggaagacgtcaccccggtgtacggccgcctcgaagagcgcccagcgcgaccagaactccttgttctgctttccgcgcggcgcccagaccggcacgtcgaggtccaccccctcgagcgccccgaccagccggtccgccggcatggaagagccaggtctgcagcgcgaccggcactgcgccgtaggccaggccccacagggcgaggacgaggaacgccccgactgtccacgtcccgaagaggggcatgagcagttgcgacacggcgaggagcgccagcacggccggcaccgtgggccgcaatgccttggtgagcgccgacgcggcggcgaaattgcccaggattccggctgcggcgaagaccagcagcagcgtgctgatcagggtggggccggctccggtctgctgctgcaggaagggcgccacgaaggtgtaagcggcgaactgcgccgtgatggtcagcaaggtcatcacgagcgcgacgcgcgcacggccgctcttgagcaggacgcccagggagcgcagggtgacggccttggtgaccgggaggcggggcaggaagagtgcctggaggatcaccgggatcaggccgagcccggccacgatgaagaaggccgcgccagccgaactggtggcccaggagcgggcccgcgggtacgcccacgacggtgcccgatggagatgccgccgaagatgagggcggtggcccgtggcgcgagctgctcgggaaccaggcgggtgccgacccctaccgcgatggcccagaagccgccgatgccgatgccgaggagggcacgggcgcccagcatggcggagtagtcgggcgccagcggctgctcggcgtcttcgacgggcagggccagctgttcaccgagcccggcttcaacggctgtgcgcacatgacggccagcgcggaggtacggcccggcagcccggtggagggcgccgccgaccggtaccggctgtgggtgcggaccatgttcacggatctggcccgggaggccggcgtcgccgacgccgagggcctggcgcggcagctgcaccttctgtacgacggcgcggggatttcggcgcggatggaccgcgacccgtccgcagcgacgaccgcccgcgcggcagccgccgcactgttcgacgctgcagtcaaggacaaggaactggtcgacgccgggcagtaatccggtgggactccgaagcccccgcagaggaccagctcaaccgagggcatacactccggccccgaaacgctgggcgctggaagcaccgacggatcctgacgtccacgcccatcgcccatcgcccattcagggatgaaacaccgcgaggagaccacctatcgcggccttacgcggtactggtgcggctgcgcaggtcggtgcgggcggtgtcgaggatttagtcggtgggggcggggtcggcatcggcgacggcgcgtgacagcagcagggcaccggccatctcgctgaacaatggcgcggcagggatcttgccgtagcccttccgtgaggccgccgtcgcacacctctcgacggatcttgcgggagctgatcgagggcggcgccgctggaacaccggcgccgcatcggtaccgcgccatggcgagcttcttcgaccctgcggcacaggatctgcatcagccttgcatgaaaatgcgcgaggatgcatactcttcctatgtctaaggtcctcacctcccttcccgccggcgagcgcgtcggtatcgccttctcgggcggcctcgacacctcggtcgcggtcgcgtggatgcgcgacaagggcgccgtcccgtgcacctacaccgccgacatcggccagtacgacgagcccgacatcgcctcggtgccgggccgcgcgaagacctacggtgccgagatcgcgcggctggtcgactgccgcgcggcgctggtcgaggagggcctggccgcgctcacctgcggggcgttccacatccgttcgggcgggcgtgcctacttcaacaccacgccgctcggtcgcgccgtcacgggcaccctcttggtccgggcgatgctcgaggacgacgtacagatctggggcgacggctcgaccttcaagggcaatgacatcgagcggttctaccggtacggcctgctcgccaacccgcacctgcggatctacaagccgtggctggacgcggacttcgtgaccgagctcggcggccgcaaggaaatgtcggagtggcttctcgcccacgacctgccctaccgcgacagcacggagaaggcgtactccaccgacgccaacatctggggcgccacccacgaggccaagaccctggagcacctggacaccggcgtggagaccgtggagccgatcatgggcgtgcggttctgggaccccgcggtcgagatcgccaccgaggacgtgacgatcggcttcgaccagggccgcccggtgacgatcaacggcaaggagctcgcctcccctgtcgacctggtcatggaggcgaacgcgatcggcggtcggcacggcatgggcatgtcggaccagatcgagaaccggatcatcgaggccaagagccgcggcatctacgaggcgcccggcatggccctgctgcacgcggcgtacgagcgcctggtcaacgcgatccacaacgaggacacgctcgcccagtaccacaacgagggacggcgcctcggccggctgatgtacgagggccgctggctggacccgcaggcgctgatggtgcgcgagtcgctgcagcgctgggtcggcgcggccgtcaccggcgaggtgacgctgcgactgcggcgcggtgaggactactcgatcctcgacaccacgggcccggcgttcagctaccacccggacaagctgtccatggagcgcaccgaggactcggcgttcggcccggtcgaccggatcggccagctcaccatgcgcaacctggacatcgcggattcacgcgtcaagctggagcagtacgccggcctcggcctgatcggcaccggcagtcccgccatcggtgccgcccaggcggccgcgaccggcctgatcggcaccatgccgcagatgccggagggcagcgccgaggccatcgcctcccgcggcgaggtctccggtgacgacgagatgctggaccgcgccgcgatggagttcggcacggactgaccagccgcgccgagcggaaggctcggcacccccgagggggatgcaccaccgggcaaggccggctcggcgccaacggcgtcgggccggcctttcccgttacccggggctgcgcgctctgcgcagcgcacgacgtatggatcgccccgccctctccctcctaccgagggcagatggacgctccctgagggcagacgggcaagctctacagccttgacgtgaccgcgccacggccctactgtcgcgacaccccatgttcatgttgacacacaaagttcacagacatgaacaccggacgcggagtagcaagcgcgtccgtcaacgagcccaccgagccgacgggaaggcaccccccatgcgcatgcgtacgctgctcacctccctggccaccgccaccgccgtcaccggcggcctggccctcgcggctcccgccgcgcccgccagccctgttcccaccgccgcgggcgtcgccaacacgcccagcggccagggcagtacgaacgtcgtcgcctcccccatggcggatccgtccgtcgcgcccggcgggaatttcgacctctcggtatggcagcttcaggagccggtgggctcccccggctcgccgacgacgatcccgtcctcccggcttcagggagccaacgggttccaggacgcgtacttctacacggacacccgtgacggcgcgatgaccttctgggcaccggagaagggcgtcaccacaccgaactcgaactacgcccgctccgaactgcgggagatgaaccgcaacggcaccgccgccaactggtcgctcagcggcacgcatcagatgaaggcgacgctgcgcgtcgtatcggtcacatcgaacgtctgcgtcggtcagatccacctcggtacgggaggctcgtccaccaagccgctgctggagctgtactaccggtcgagcggtgacatcgtcctcggcacggagaactcgccctccggagggcagacactgcacaccgtcggccatgtatcggtcggcaagacatggaactacacgatcggggtctcgggcggccacaccatcgacttgacggtcaacgggagcaccacgcactacgccatcccgtcgtcgttcgacgcctacaagcagtacttcaaggccggctcgtacaaccagtcgtcctccgacagcaccaccaagggcgctcgggtcgccttctacggcctcaccgtctcccacagttgacgagcctcgacgcagcggcatcaccttccgcggcggtccggggaggtgcgcgccccacggcgccccccgacgagtgaggtgatggcccgcaccggcgatcgacgcaagtcgtgcgtccgggatgcgggcggcgagctccgtaccagggggccggcacgcgctccggcccggccgcgcgtcggaagcgggtactgaaccaaccgcttccgacgcgcgtcagccggtactgccggcacgatccagtgcacatggggcggccaggatggcgccgtgtcgtcgccgcgccgactacgccatgtcgctgcccgcacccggcgcgtcagcccccagcgccgcgtcgaccacgagtttggcctcctgctgcacctggctgaggtggtcgggaccgaggaacgactcggcgtagatcttgtagacgtcctcggtgcccgaagggcgggccgcgaaccaggcgttgtcggtggtcaccttgatgccgccgattggcgcgtcgttgcccggcgcccgggtgaggaccgcggtgaccggctccccggccagggtgtccgcgccgacctgggccggggacagcttggcgagcagggccttctcctcacgggacgcgggggcgtcgatgcgcgcgtacgcgggctcaccgaagcgggcggtcagcgcggcgtagtgctccgacggcgtcttgtcggtgaccgccgtgatctcggaggcgagcagggccaggaggatgccgtccttgtcggtggtccacaccgagccgtcccggcgcaggaaggacgcaccggccgactcctcgcccccgaagccgagcgacccgtcggccagcccgtccacgaaccacttgaaccccacgggaacttcgaccagtcggcggccgaggtccgcggcgacgcggtcgatcatcccggacgacaccaatgtcttgccgaccccggcgcccgcgggccaccgctcccggtgggagtacaggtaggagatggcggtggcgaggtagtggttgggattcatcagcccggcgtccggcgtgacgatgccgtgccggtcggcgtcggcgtcgttgcccgtggcgatccggtagcggtcgcgctgctcgatgagtgaggccatggcgtacggcgacgagcagtccatgcggatcttgccgtcccagtccagcgtcatgaaccgccaggtggggtccgtgagtggattgacgaccgtcaggtcgagcccgtgctgttcggcgatgcggccccagtaggcgactgaagccccgcccagcggatcggcaccgatacgtacgcccgccgcgcggatcgcgtccaggtccagcacactcggcagatcggcgacgtaggtgcccaggaagtcgtaccggccggtgccgggtgcggcgagcgcctgggtgtagggaacgcgccgtacgtctttgaggccgcccgtgatgatctcgttggcccggtcctggatccaggaggtcgcctcggaacctgccgggccaccgctcggcgggttgtacttgaagcctccgtcggcgggcggattgtgcgagggggtgaccaccacaccgtcagcgaggcccgaggcacggccccggttgtaggtgaggatggcgtgcgagaccgccggagtgggcgtgtagccgtcatcgctgtcgatgagcacggtcacgccgttggccgcgaacacctcaagcgcggtgactctggccggctcggacaaagcatgggtgtcggcgcccagaaagagggggccgttggtgccctggctgtcgcggtactcgcagatggcctggctggtcgcggcgatgtggtcctcgttgaacgccgtcgccagcgacgatccgcggtgtcccgaggtgccgaacgcaacgcgctgccccggttcggccgggtcgggatgcagcgcgtagtacgccgtgaccagcttggcaacgtcgatgaggtcctcgggtcccgccgacgtgcccgctcgctcatgctgcatacctctgctcctccacatcagacgaccattgcctcacgttctcatgctccccccgcacgcccgacatgcgcgataccgcacggctgccatgccgcagccgaaggccggatcccgcaaggcggacagttcggcttcatcgacggcgagaggcaccccgtggtcggcatcgaggacggatgctgaggtcacccgcgtggcgtcgtcgtacgaccatcaccatcagcggcagccggaaggtcggcatccgacgccggtctccggcacttcgacggcccctgaaatcagcaccttcgcacgggtgttgcgaccgttggcgggtcctctctcaactcggcccccaggggcagctgtcgaaggcgagggggacggttccgcggctgggcctgcggggctctgcgcgggcgcgtgagccgtgtccggaagagtaggaccagcgttgggccttgaccggggcacccggtgtggcaagggctgggaggcgggcctcgcagcaaaaggcgcgagacccgactcttcccgagaccccggaatcaggtgctcaggccctgaatgggtgcgaagaccgcgccgccgtcgaagtcctggttgcactgcacggcttgcaggttgccgatgatgacgtcagcctggccgccgtagcggtggccatcgccggcgtcaggcccgatcaccgtgcaggagttgccgatcgtctggttgttgtccccgtgcgcgaccccgccgccgagagccatgccaccgaccatgaccgctacggccgcggccttcttgaacttgctcatcactactccgattccttcgcacgccggatcccttacggacctcgcctgcacagtcacagaaaataacagatcgctcacttagcgttgcaattgcggcacttgcgtgagccgtgccctggacaccgcgggcaccctggcacctgagcacccggccgtgctccctggcgcggcgcgggcggcctcgcctcccgcttcggccgcaccctgctcttcgaggactccgacgaggaccacgacgccgacgagccggtctcgatcgtcgagtaccaagcagggcagcacccccacgaactgcccccactgcccgtaccgaactccccaccctcttccggaagttagcgagggatgatgacatcgacaacggacgctttgcccaccatccgttccaggagacgaccgaaatccagacccagcggatcaccgaactccccgccccgacctcggatcagctgatcagctgatcagctgggaggcgcagggtctgccggcccctgccgaacgctgagcgcggacgtgcggtgtccccctcgaaagggtccacttggatgaaatgcgccccgcccacgccctcaaggagggacacatggacgacatggactactacgatctcggcacccacagccgctccgtgaccacctcgtcccccgaggcccagctgtggttcgaccgagggctggtctggtcgtacgccttccatcatgaggaagccgtcgcctgcttcgaagccgcggccacggcggatccgggctgcgccatggcctactggggcatcgcctacgcactcggccccaactacaacaaaccctgggagttcttcgacgagcaggacctcgtacggaccgtcgagcgcacccatgccgccgtggagctcgcacacgcgaaggcggccggtgccaccccggccgaacgggcgctgatcggcgcgctgcgcgcccgctacccgcaggcggaggccgtcgaggactgctcggtgtggaacggtccctacgccgacagcatgcgtaccgtgcacgaactcgcgcccgacgacctcgacgtcaccaccttgtacgccgacgcactgatgaacctcacgccctggcagctgtgggacctgcccacgggcgagcccgccgaaggcgcccgtacagtcgaggccagggccgtcctggagcgtgccctcgccacggacgcgggcaggcggcacccgggaatcctgcacatgtacatccatctgatggagatgtcccccgccccggaggcggcgctgcctgccgccgaccggctgcgcgacctggtgcccgacgccggccacctccagcacatgccctcgcacctggaggtgctgtgcggcgactaccgcggcgtggtggcggacaacagcagggcgatcgccgccgacgagaaggtcctcgcccggtccggggcgatgaacttctacaccctctaccgctcgcacaactaccacttcaagatctacggcgcgatgttcctcggccgttcccaggtcgccctggagaccgccgcccggctggagtcgtccatctcggaggagctgctgcgggtggagagcccgcccatggccgactggctggaggcctttctcgccatgcgggtccatgtactgatccgcttcggccgctgggccgacatcctgcgcctgccgatgcccgcggacccgcagctctacagcatgaccaccgccatgctgcgctacgcccgcggcgtcgccctctcggcgaccggccgggtcgcggaggccgaggccgagcgcaccctgttccacgcggcggtcgcccgggtccccgagacgcgcatgctgttcaacaacacctgcgccgacattctcgcgatcgcgtcggcgatgctcgacggtgaactggagtaccgcaggggcaacttcgacgccgctttcgcggcactcctgcggtcgatcgaactggacgacaacctcccctacgacgagccgtgggggtggatgcagcccacccggcacgcgtacggagccctgctcctggaacgggggcgcgtggcggaggccgaggccgtctaccgggccgacctcggcctcgacgacaccttgccccgcgcctcccagcaccccggcaacgtctgggccctgcacgggttccacgagtgcctcgtccgcctcggcaagacgggcgaggcgcagatcgtggcccagcagctcaggatcgccgcggcgcaggcggacgtaccgatcgaggcgtcctgcttctgccgcctcgaagccgtctcgggcagcggggaggcggacggctgctgtgcgacggaagccggtcggggtcagtgaccccggtggcccgggcgggcgccctgccacaggtgccgccgtcggtggcgtcctgctcgcccccctcagctcctgagtcggcgagcgggccgccggcctctccgatccggctgttccggtcggccgaggtcggtccgcgctgcccagtcccaggatcgccgccgcccgacctcacctcgaaggcggatgaagaggcccggggcgggcaggagaggtagatggctgacctttcgcagttgctgcaacagggcatgcgccgccgtcacctgaccgcgcaggctctcgccgagcggaccggcatccgcactccccgcatccgcgtcttcgctcaggacggcgcccgtggtcccgtccatcccacggaagcggagctggctgaactcgccgccgcgctggccctgcctttgccggaggtcctcgacgctgcccgcactcccgccgaagcgtcgcaggtctgacactcgttgcggcctcgtgcgcgccgcggccggcgcgcacgccttggcggcgcggatgatctgcccctgggagcggcgcggcgtggaggaagccgcggcgccggccccgtgcgcatgcaacgtcgctgggctgccgccggcctcgcgcggtaaggcccgggagggcgcccggccggtgggaccgggccaggcgttcggaggcacgcatgcgtgcggcccctcgggttatagacgtacgaggatcaaggcgatgtcgtcgcgggcgccgccggccacgtcgaggcgggccagcagggcgtcggccagacgttctgggctcaggcgcctgtggcgggccagggcctcggtgagccggtgcaggccggtgtcgatgtcctcgccgcggcgttcgatgagcccatcggtgtacaggacgagggtgtcaccttgggtgtagggcagatcggcctcggggcgggggacgtgttcgaggcgggcgcccagtggcgggtcggtggcccggttcagcaggtcgcaggtgccgtcggggtgcagcaggacggggggcagatggcccgcgctgctgtagatgatccggtggttgatggtgtcgatgaccgcttgggccactgtggtgaccagtgctccctctacggaccgggcgtacagacccaggacctccagagcttgcgcgggtccgtcgacggctctgacggaggcgctcagcgcactgcggagcatgcccatgacggcggcggcctccagcccgtggccgacgacatcacccaccgcgacgccgatgcggccgtcgggcagatcgaccacgtcgtaccaatctccgcacacgttcagtgaaccgaccgcgggcaggtaacgcaccgcgacatcccggtgtcgggccaggtccggcgagcggagcatggcctcctgcaaggtgacggcgacctggcgttcacgggcgtgggcctcgcgcagttcctcgttcagccgctgcagctcccgcgcccgcgcgtacagctcctccaccgcctcccgcccgctgagcgcctcgccgtccgcctgggggcggtcggtgtggggcacgacgaacgcggtcacgtcctccacctggtgaatgatccacaccacctgcccgtccggggcgagcacggggatgttgaccggcgaccaccaccgctcctcgaacacccccgcctgacctgcgacggggatgtcgtacttctgcaccgtcatcgtgtccggctccttcgagcgcaggacccggtgcagcgagagatccaggttccgcactccgtcagcgccggggtccgccggattgtccgggaaggcgtcaaacaggtaccgcccgaccagatcctgcctgctccagccagccacccgcaggtaagcgtcgttgacgtcgaggatgatcaagtcgggacccagcaccaggtatggcgtgggcacggccgagaacagcgcctcgtaatcgatctgcggtgtcacaggctccgtgccagtcctttcagcatcgtcggtgggtcctcccgctgctcctgtcctggcgcacaggcgatcctctgtcaccctcgggcgataccgacaggagagtcagggcagaacaccacagaaggtcacgaaaaggtagtatcgcctgaatcatgccgcatgtctgtttgcttgctgttgacgcggctctcgccctgacgatcacgacgcccttgaaagagggcggacgggaagacccgaaagccccggaggaagccggagcgagcccacgacgatcccgtgcttccgactctccttaccggctgatccgacgcggaaccgccaccgcgacgagcttgtccgggttgcggacggcgtagatgctggtgatcctcccgtcgatgatctcgaccaggaagacgccttctgggtggtcgccgctgtagatcaccatcgcgggcgtgttgttgcagttgaccaccttgatccgcgggtccgtcagccgtcccatgcggaaaatgctcatgaggaccgcggccaccttctccgcccccaccaccggccgacgcgccgcggtggtcttgccgccgctgtccgcagtccaggtgacgtccggtgcgagcagcgagagcagcccctccaggtcaccggttgccgccgcggtcatgaacggctcggtgatccgcgcggccttcgccgcgccgacgggctcgaagcgcttacgccgcgcccgcacgtgcttgcgggcgcggtgcgccacctggcgcaccgtcaccctggacttacccaccgccacggcgatgtcgtcgtaatcgaagccgaacacctcgcgcagcacgaacaccgcacgctcatcgggggtgagtgtttcgagaaccgctcggcgtgctcgtcggtgctcacggggaggtgacctcctgcgaagcggaagtcggccgctcggggcgagggccgcccttgggccagccgatggaacccggcttgcgggcctcgcggcggatcctcttcggcacgacgaacttgcaggtcacctccttgagcgccgcgcccatgcggccgccgatgtagacgttcaccgcggtgtcgtccttgcgggcgagctgtcggatggcggcgcgtcggccgaggctgacgcacgcccccgtgaaggccaggtcgatcaccgtcggttcggtccccgcaatggggctcagcacggtgttggccgcctgtgccccgagcggcccggcggcgtagccgctcatccgcagcggccggcccgacggtgcggcggcgtcgtcggccgcgacgatgcgggcgtcgtcgacgctggtcagcgtctcgtcggtgagcagccggccgagcgggtcggtgcgcagcccgctcgccgccgccagctccggcacgccgaaacctgccgcccagacggtcagtgcgctcggacgcaccgcgccgtcggcagaaccgtcggcaaggacgaccgcatccggccggacctcggtcaccacgccggcctccagcacggcgacaccgtgccgggtcagccacttggcgacgtatcggcgccccggcgcgctcagggagggggccagggtccggccacacacgagcgtgaccgtgcgtccttgctcggccagttcggcggccgtctcgatgccggtcaacccgccgccgaccacggtgaccggagcatcgcggggcacctcctccagcctggcgcgcagccgctgcgcggactcgaattcagcgatgggcaaagcgaattcgaccgcgccaggcaccattgacggtgtcgctgcggtgctgccgaccgcgtagatgacgtagtcgtagtccagggcgcggcccgacgccagccgcacggtgcgggcggcggtgtcgatgcgcgtggcgctgtcgacgaccagctggcccccgccgagcagcgtgccgtagtcaatcgtggcgtcgccgctacgggccacgaactggtgcagccggatgcgttcgacgaacttcgggcggggattgaccagcgatcgcaggccgctcgcgtgtgccagagctgtcacatgtgctggccgtagtacttgccgaactgctcaaggtaaccggggtcgcccgtgtgcttgtccctgtcgaactcgggcgcatccttgatctcgtccttggtgcggtcgacgtagaccttccgctcggcagtgtcgatgcgtgtgatggtcccggccgggagaagcacgtgcttgccgaagatccaagcaccggtgtcgacgacgaggtgggcggctccgacgtcgtcggagtgcttgtcgatcttgccgatgctgccatcggtcgcctcgactttgaaaccgatgagatccgttcccgtctggtatcccgaggctgggtggtagccccaaatctcttcactcacaacagaattcccttcctttgctcgacgcgaagagcggactgcacccattggtccgtgaatccatttcttctgtaaccgggtgcagggaggttgagagtgcagtgacttctggtgtcacgaccgggacgtaagtccgcgaggtaccgccctggccctacttcttgcccgtgcggcagaaaccggtcgcagatggcctccagacaagtcccggccggggttggagaccatctgccgttgagtggccgtgtcgcactcaggtgctactggttccgcccgccgccagcagtgcccttggacctgctctgaccaggctggccctgctgcttgctctgctcctgcaggccccgggcctgctcctggagcttctgacgctcctgcgggtcggtcgtgcgctccgcggcttcggtcagcttctgggccttctcgcgcatctgctgtgctcggttgccggattcgcctgcggcgctcatagtcactccttggactgtcgggaagaacatcgggctctatcagccaagcagcacccgatcacacccgcatgccgaaccgtcaccgtgcgctatcaccgcaggtcggtcacccctcttcggcaacgaagcagaaaactgcacagcgcgagccataggactccccttccttcaggagggggaggaagtcaacctgtccatgagcggtcagcggcgcgccagttgccgttcaccggcggcaccgggttcgtagggcaggccgtagtgtttgaagatcgcttcctcctggtcggcgggcagcacgtcgtcggtgccgatcgacggggcctgtttcaccagtgctctgacatagccgaccttgagatagcccggcccggcgatcgcgtcctcgagggggacgaaggtcagccggtgccgggtgggcagtccggtccgtacggtggccatggccggctcgtcggtggtggtgtccacgtagaccgcttcgaggacaccgatcttgtggccctcggtgtcgacgacgtctcggttgcgccactcgcggacatcggctgcgtgaatcatggccttccccttacggacggctcatccgccggtggtgagtcgcacgcctggtcttccgcgtaaagccgatgcagcgcacgccgcagcgcccgctgtatcagccgcgagagcggctcaccctcccaggcggcgaccagagccgctgccacgtccggaagcttggtgttgcactgccgcgagatatccaccagtagtttcctggccggcccacggcggcacggggccaggaccatcaccatgccgtaggcctggtcgatgaccgcacggccggccagcgcccgacgcagttgatcgatctcggcgcgcagcgccacgacatcctgacccgccgggtcatccaccgaggcctcggccctcagatcccaccaatcctccggaagcatggttgtgcgatgcatggcgtccgcctctccacgatgtgcgtgcgtccggcgtggctgaagccgccccggaacctctggatgtcgggcaacttcatcggtcatccgcggcgttcacggtcccgacggtcctcgcgcgtccagcgcgcccggtgctgacggctgtagcgacggtcccagcggtcctgacgatcccggcggttctcgtagtcccggtactcccctaaatcggaaccgtcaccagagatccagcccccgccaccaccgcggccgtaccgggtggcgccgaagaccaacacggctgcggccacccaccagagggggctgaggaagccgaggccgaacaagaccacgatgaggatgagaagcagaacgaacacggcgggccttcccggagcggaacaaggcatcactgccggggaccggggcctgttcgaacagcatagtcctgcccagaggttgcggatagccgcccacgtcagcgtcctctgccaagaccggatggccacttgacatctgttcagggagtgcggcgagggctagcgtgcacagtacggcccgagcccccggcagcgtcgatcacctctcgcgctccttcggggcgcacctggcgcatcagtgccggaacctgtcccgccgccaacgggccgctcccgcactcgccgtcgctacgcgatcctggcgcagcctcgatgcgccccaagcgggcaccgcccatctgctgtccgccgcgtcgcacacatttcacgacaggcggtacacatgtacgcgctgatcgttcccgcttcgactcccttcgtcctcctcgccaccgtgatggccctgtcctggtgggaggaccgtgtcctgccggcgccgccggccgagccggtcgacgctcccgccgaggctccgttcaccccagcggcacctgcccacctcgcagaactcccccgcgtcgacactgcgttgacaagggaagccgccgggcgttgactgacagcacggcgtagggctatgccactccgaattgctcgggcgcagcattccaccttcccgcttcgcccggaccccgcggaactcaggcacttcccgcgatctggaggcccggcgatggtatggattcttctccttctgctgatcctggtggtgttcgggttcggtttcaccatgcaggccctgtggtgggtcgccgccgtattgctggtcgtctggatcgtcggcgtcgcgatgcgcggacgtggcggtggcgggcgtggcgtcggccgccggtacggccacagtcgcaggtagcccacaccagggcccacaccaggcgctctccccccgcccgcgggaatagcggcctgtacggcaatcacccgcgggatcccacccagcgaacatgcatgcagaggacagccatgagcgtcggacagacgatcaagcacaagacgcaggcattcaagggccgggtcaccgaacgcatcggccggaccacccgcaacaggcgactgcagcgtgaaggcaggaccgaccagatctccggaaacctgaagcagtccggcgacaaggccaaagacgccttcaagcgctgaccgcaagcgccccgggtggcgcccacgtcgcgcggacaccacccggcaggccacggggacgccgtgaggggcgcccccgactcgcagaccgtcgtcgggaactgtgcacccgcgggaatgctcacccggtgcaggcggaacggattgcggttcggccccaaggtgtagcgcacggtgggacaagtctggctggtgtccgtggatacgtagcggatccgggtgccgcggctggtcagttgggtccacgcccaggcatcgtcaccgacaccgtcgacctgtgcaccgccactgaggcgaacggtctacacgtggtaccgccggaccagcgcgcggatccacgagcctgccggggattcttcggctactggggcagccacgcggtcacgaagcaggtaccaggttgccgtccacgatgcccgcggctccctcggactgccggtcatccgtggcacgttcgccaaggccctcgatccggggatccccggcaacgcgctgtacgggccggagggcgggcccctgccaccggggccctccctccggccgctccgactcctggacgcggacgacgagcagatcagccgcgtcagcagcgctccgaatcagatgcacgcctgaacgccgctacgcggaagccacaaccgccccggccatgacctggggagggttggggaggagtgacgcgaggttgtcccgcacgaagtccgacgccctcgagatcgattcctcggcaccggcccggtcctggaagacgctggtcgagaccatcactccgttcccggcatcgacccagtagtaggccacgaagccggggacctcgcgcatgagccccacgaagccctcgttcacgaggcgtgccgcctcggccggatcggtcaccccttcgtaccgccggactgctgcgtacatggccgatctcctcgtgggttctgggttcgtcctctgctgagactccttacccctgcgacagctacctccctcgcgaggcgtccagcaatcaccggaagggccgccctcggtgatccgaacggcggcttcggcgccggatcacagccctgcgccggtgtgtcgcggccgatccacggcaggcctcatcacagaggagtagcgcacgcccctccacacaagtgatcgagatgccggggctcacccgccgtcagttccgagggtgccggtgacgtagctgcggcagttcgcggactgacttcgcccagcgcccggtcccacaggtagctgctggccgtggcacatcggtgttcaggacgccggccagctgccaagggtagggtcgatcgcattcgcgagatcgctgatgtggatggttcgggccttgaggagttgttgatggaccacccggaccctcggcacagggcacgccgggccacgtacggatccgtttccacgcacttgtcgctgctgagtgaccatcgactcggcgaagtcgtggccgcagccacccctctcggttccggcatcgggggcaggtcggcggagctcgaggtcggtgggacccgagtcttcgtcaagcgagtccctctgacggacatcgagatgcggccaaagaacgtgcggtcgacagcgaacctctttgggctgccgatgttctaccagtacggggtgggctcagccggcttcgggacctggcgcgagctggccgtgcatacgatgaccaccaattgggtcctcgggaacgagtacgagggctttccgctgatgtaccactggcgagtcctgccggacatccctccccagggattcgccgacattttcgggggcatcgacggggcggtcgcgcattgggaaggctcgtcagccgtgcgtgagcggctggaagccatcggccggtccaccttcagtctggtgatcttcctggaacacgtcccgcagacacttgccgcgtggctgggcgaccagcgaggggccgcttcggaaggcgaagacagccaggggtacgcgtgggcggaggaggccctgacgcgcggagccgccttcatgagctcccgcgggctcgtccacttcgacgcccacttccacaacgtcttgaccgacggccggttgatctatttcgcggacttcggtctcgccctgagctccgggttcgaactctcgcaggacgaggccgagttcctcaccgaccatctcgcctacgacggctgctacatcgcgaaccatctgctgcgccaccatctacccgacggcgtgcgcggcaaggtggagcacgaggcgtttctgcacaactggatcgcgggtgagaggtccgagggggtcccgcccgcgatcgccgcgatcatcgaccggcacgcccgggctgccgtcgtactggacggcttccaccaccgcctgctcaatgtgagcaaacggacaccgtatccggccgccgacattgagcgggccaggccgggtggtcgttcagcggggtagaggcgggcggggttggctgagcagcaggcggacccgcccatcggaaccggaaggctccgagatggtggtcagccgggaccccgaggtttccccgaaaagcgggtggaatgtgctcagtggaatgccaggggcccgctccccctgtcggcggatgtgtcgatgcgggtccggggccagattggccggcatgcgaatccatgcacgtatgaccaccgcagtggctcttgtcgtcaccctggccgtcggctcgggcacggccgcctccgccgcctcctcatccggcccgataccctcggcggctcatggtgccgtgcggtttgacctgcccgagccgacggggcggcaggcggtcggaaccactgaacttcatctcgtcgaccgtgaccggcccgacccctgggtcgccgacagggaccgggagctgatggtcagcatctggtatccggcgcgttcgacaagcggatactcccgccagccgtacatgcagccaggcgccgcgcgcttcgtggacgagtcgggctcgttcggactggcccgtcccggcgaggtggactgggccgccacccggacggacgcggcctcgatggcccccgccgacgaccggagcaggcggccgatcgtgctgtactcgccgggcctggggatcccccgcgcgctgggcacctcgacggccgtggaactggcgagccgcggctacgtggtagtcaccgtggaccacacccatgagaccactccggtggaattcccggacggccgcgtcgagttgcagaaggagccgatggccggagccgagacggtcaagaaggcggtcgacacccgggtacgcgacacccgcttcgtcctggaccagcttgccgtgctgcgggccggccgcaaccccgatgctgaggagcgccgtctgccccgtgggctgggcagggcgctcgacctggaccgggtcggaatgtacggccactcggctggaggtgtcaccgcggcggagaccatgcgggtggaccgtcgcatcgacgcgggcatcgacatggacggcacgctccagtacaacagcaccgaattcctcccggtggccctggaagggctcgaccgcccgttcatgctcatgggcaaggcgagccagactcatctgaacaagccgtcctggcagtcgttctgggaccgctcgaccagctggaagcgcgacctgagcctggaacggggtggccatttcagctacaccgacgcccagacgatcgtgcccgccgtggacgagcggctggacatcccggcgcagacccgcgagcagttcatcggcaccgtggatcccgagcgcagcaccgcagcccagcgcgcctacgtcacggcgttcttcgaccagcacctgctgggccggccccgacatctgctggacaggccttccccgacccaccccgaagtgcgcttcgtccgatgagtgcggcggcctcggcagcggtacgacatcgtcgcgccgccgccaggtgtgagggctcctcgcagcacacggcctgatcgcggtctgccgaccttccgttcatcaggaacctggtcagccagggcgggagtggtgatcgatgccggccgccggtccgtccgttctcgggcggaccggcggtacttcagatgccggagggcgacgacggggtcgtaccgggtactgcccggcatcagcaccggcctcagcgcatccgctgccgaacgttggccggaagagaaaggtccgcaccggctgcgcagccgaggcggccggccgatcacggcatggcggcccgctcggccggcttctggtcatcgcatcatgtcgatgagtccacgggcccgagatcgagcgggggtgagggaagtccgaagtggtcggcgatgatccgcaccgtgtgggcgccatccgcgttgaagccgggatcggcgtcgtactcgggggtgtcccggccgacgatccgagcgtccagcagctcgcgtacgagcaggtcggccctgcctccggcacgccgtgactcgcggcgccgaccgacgttgaagtacgtctgctcgaacccgccgcggctgtaggcgaactggaacgggtgctcggcgcagtgagggaccatcccttgttcttcgcagggaatcccggccttcaggccgggcgggaatgcgatcctcggtctggaggcgcgaagcgccggagatcactgcgcctgtgcggtgacggtcatgccgggcgcttctggttctcgatgtagtccttgacgatgtccagcggtgcgccgccgcaggaccccgcgaagtaggacggggaccagaacaccgagcccgtcccgatccggttgatccggccggtgtactccgcgcgcaggtagcgggagctgacgcctttgaggctgttgacgagcctggacagggcgatcttcggcgggtagtgcacgagcaggtggacgtgatcgccttcgccgttgaactcccgcagttccgcgccgaagctctcgcacacgtcgctcatgatcgcctcgcagcgcgtcagcatctcgccgttgaagatctcccgccggtacttcgtgacgaacaccaagtgtgcatggaggttgaaaacgacatgatttcctcgtcggatatcgggatccggttcccagcgcggtgacatacgccaagtgtagtaggatcaagcgaactcgaccggagggggtgggctggatgatccgtgcgtacaagttcctcctgcggcccaccgtccgccaggcccaggcactcgccgagatgctgcgcgaccactgctccctctacaacgcggcgttgcaggaacgccgcgacgcctggcggcacccgtcgaagaccaccgtcaagtacggcggccagtccgcgcagctcaaggacatccgggcgttcgaccctgagcgtcagggccgctggtcgttcagctcgcagcaggccaccctgcgccgcctggacaaggcgttcgccgcgttcttccgccgggtcaagtccggtgagacgcccggctatccgcgctttcgcggggtgaactggttcgacacggtggacttccccaaggacggcgacggctgccggtggaactccaccccgcacgacccggccacccgcgtccgtctccagggcgtcgggcatgtgaaggtcaaccagcaccgcccggtggccggccgcgtcaagaccgtctccgtcaagcgcgagggccgtaagtggttcgtcgtgctcaccgccgaacaggaccagcccgaaccgctgcccgcgaccggcagcgcggccgggatcgatctgggcatcgcgaacttcctcgccgactccggcggcgggttcgtacccaacccgcgccacggccgccgagcggccgacaagctccaggcagcgcagcaggccctcgcccggttcccgcgccgcaaggccaaggaccgcaccgccaaccaccggcgcgcggtgggcaaggtcgcccagctccacggcaaggtacggcgccagcggctcgaccacgcacacaagaccgccctcggcctggtccgcgcacacgacttcatcgcgcacgaagacctcagaatccgcaacatgagcaaggcccccgcacccaagcccgaccccgacaagcctggcaccttcctgcccaacggggccgccgccaaagccgggctcaacaagtcgatcaacgatgccggatggggggtgttcctgacgatcctgcacgccaaggctgaaagcgccggacgggaagtgatcgccgtggacccccgcgacacctcccgcacctgccccgaatgcgggcacaccgccaaggagaaccggcccacccaggaaaagttccactgcgtcgcctgcggccaccacgcgcacgccgacaccgtggcagccaccaacgttctacgggccgggctggtccgtcgcaacgccaacccggcatagcgagaagcccccggcttcagccgggggaggagtcacgtagttctgcccgtgcgggcacccgcatgcgggtgtggacgccaggaaaacggtgtccacgctacgcggatcgcttgcgcggtccgtatagcggtagcccgtgatattgcgcgccagttcccaggcggactccccacgcggggcggtgtaggcgtcgtgcgtcacccatgcccaaccggacgactcgccggtggcgagggcggggcgccccgcttcggtgaagatggcggacacggtgggcaaggtcatgcccttgcagaaggtgacgaaggtgttcggggcaagccagctcacttcgcggtcacctccgcggacagaggcggcgcgggcagcgcgaaacagtcggcgatcactgtgacgagacgctcgtgatcgtcgtagtggtggtcgaaacagtcgtgcccgtcgtcgccttgttgtccgcattccgcagtgggaccgatgaggttcgcggccaggagttcggcagacaggtagtccgggttctcgcccacccgctgctggatgtcctcgaagctgaagcagaggatcgcgcggccgtcccggtggtactcgaatgcgggcgggaaggccttggcactgcagggctcggtcacgaacacaacgatctccgcgccctccgggcacatgccgctgtagtcgacgtcgtcgtagtcctcggcatcccagttgtgcatgtcgtgcacagcccacgcccaaccgttcgcctcgccgtacacgaggggttctcgtagccggtcgcgaaggcctcgggtgagcgtgtccagtggtatgccccgggcgaagacgacattcacctcgtggccggggaaggggccctgtatccagttggtcatgcgagcaccctaggcgcggggactgacagccggacgccgctcgaactctgcttcatccggcttggatcgcgtgttgtggccggtggcgtgacccacaggcaggtgatcgacgggactgcaccgggtttggaccggggtgcagtggggtgccccccggtccaaaccggccctggagaagatccgcgtcccccgggaccggaccggactggacagggccgggccgggccgggccgggcaagccacgcttggcaagcccagctgcgccaagcgcccggatgcgaaggggccttcactacggcagatcgggcgcgtactcaacgtagagtggactcgcgatcaggtagcgagccgtagcttcacttcctcgacgcgccaggttggccgtaacccgagcgcatccgcgcatccaagccgacgtctccgggtctatctttcgatcaactgccgagacaagggagacagtccctcgacgcacgaccgggccccggagtgcttcccccatgcttccgctgaggcccgggacgggcgccagagggtcctggtgagcggccaattcgtccgccgtccaactcattgcccctgtagcgaggagagccatgaacgcggcgagtgtgccgtacccacctgtaccggacgcgatgacaggaaccacgggctggtcggctgcctctggcagttgcgcctgaattacatgactgatggagccatgcagcaccagacggatgcttccgggtgtttcataaccctcgaccggcctgaccggatctataaagagcaccatgctgcgaaaggggccgttcagcggtacgaggttgagcggtgcttcgaactggatccatcggccggggcggagccctggctccgtgaaccactcagcttccaagtcgatgcgccgcatcacctgctgcaagtgccggagccgagagcgttcgggatctttagacggctccaggtcgacgccgccgatgggggtggcgaccctgatcgtcccctggcgtccgaagcggcggggttcgggaacgaactgcctcagcttcgcatcggagagatagacgaactcccgcatgagccccccgccgtgcagttgatggggtcagcatagcgttgcgggggccggacagattgtgatcgctctggcggcttacccggcttcgatgacctgcggctcgtgcggcttggatgtcggtcactgagtcgccgatcaatacggcatcggcgagcgggacgccgtggcgcgcgcccgcctggaacttacgtcgtccgcggcgagttcacagtttctgagcggacctgtcggcatatgcggtgccgggggcccgtcatcagagggtcccggtcatccggctcggcacatgatcgcccggacagctcctagccgatgagggcttcggtgatctgacgggtggtctgcgcggcgacccgggggttgacggcggcgtacgtggtgtaggcgttcaagccggtggccagggcccagccgcggccccgggcccaggtggcgtcgtccacatcgagcgcggcgcggaaggcggcccggctccgggccgacatcagggtgaaggcgatggtcaggtcgcgagccgggtcgccgatgccgagttcgccgaagtcgatgaccgcgctgaggcggccgtcgaaggtcagcaggttgccggtgtggaagtcgccgtggaaccagaccggagggcgaccccatccgggagcgctcagtgcagcgtcccacagctcggtcatggccgccgtgtcgaacacgtcgtcgactttcgcgatggctgcccgcgtcgcgcggtcccggtcggccagcggccggacggcgacgtttttgagggcaccctcggctgggacgtcctcgggcgcgaaccgctgcagggcggtcaggaactgggccagttcgacggcggcctcggacgagtcggccagcgcctcggcggtcgccacctcgccgtccagccagcgggacaccgcccatggccacggatagtccaagtcgggctcccccacgcccgccggtacggggatggccaggggcagatgcggggcgagccggggcagccactcggcctctttcctggcctgcccggccgccccggcgtggcgaggcagccggacggaaagctcctcgcccagccggtagatcacatggtccgagccggccgggtcgagcagttccagggacagctcggcccactgcgggaactgcgtctcgaccaggcgcctgaccagcgcggcatcgatggcggggcgggtgtccgcagttcttccggttgccaagaacggctcctgcggtcggcccgctccgtgtggcgggcgatcgaggccatcacagtacgtcgcgggctctcctttcaaccggattacttgacggcctcggcgccgcatccgggtcgagtgccaaggggcgtcggccaggacctccggattggctgcgagcctctcggcgcaagcggcaagaccgcgtttccgccaacggttctgccggtagatcgtctccgtgacagccgggtccacgcgcaggtcggaccggactcgcccggtgcgcggcgagcgtctggcggaagcccgcgcaggccatctcgcgcgtcttccccggcgcctccggcacggccgcggccaccggggcgggctcaggctcgtggggcaggggtacggcacggcgccccgcaccgtttgggtgcggggcgccgtggcgttgggtcaggccggggtgacgttctccgcctgggggcccttcgggccctgggtgacgtcgaagttgaccttctgtccctcctgcagttcccggaaaccagcgctgttgatggccgagtagtgcacgaagacgtcggggccgccgccctcctgctcgatgaatccgaagcccttttctgcgttgaaccatttcacggtgccggtggccatgtttcgtccccttgtccagggtcggggggcactggcttgtcagtacccctgggtgaggtgatcgccctggtcctcgggtcctgctgcacagcacgacgcccgcggtgcgaaccgcgggcgctgagacttcggaaccacgactgctggcacgaaactaaccgatccgcagtcgcctggctacgcggcgcaacggaggcgagtgacagcgatagcgatcaaacatcggccgggagcctcaggacgctgcggaagtcgcccgcgtggacacccgaacggtctaacccgccgggccgattgtcactcactcgtacagacggccgatttctaccgaacccgctgctcacgccgggtcgccgtcggtggcggagaaccgagtaggtggcggagaaccgaggttccgtgtcgtagcacggccgacaccggccgcccgtccacggacgggcggccgggccgtgtcagcaacgcgtcagcgggctgccggacagtgagggtttccagcgcgacgtctcccatccgctgtccagcacgacatccccccacgcgccatggctcggaacccccgcagtccgcccatggaaaggaacacacgccacgaatgatccgcactgcacgaaggattgatgcgccatgaagttcaccaacgatctgtatatcgcctcggccgcgtcctggctgccggacgtggtctcggtggacgaggccatcgcggcgggactggtcgacgacgagcaccggaacctgggctacgagtcgatcgccgtggccgacggcgtcgccggccccgagatggccgtccgcgccggccggctggccctggagcgggccgtcgggatagagcgggacgaggtcggtctcgtcctgcactcgtcctgcggtttccagggacacgagatgtggcccgcggcggcctacgtcgcgaacgagacggtgggcccggccgctcccggcttcgacctccagcagcgctgcaacgccggactgggctcgctgtgcctggccgccggctacgtcgacgccggtttcacctccgcggtcctgctgaccaccggagacaacttcgccccgccctgggtcgaccgctggaacgtacagctcaacttcatcttcgcggacggcggcaccgctctggtgctgtccgggcggcagggcttcgcgcgcgtcgtctccgccaccctgggcgccgacaactccctggagcggtggaaccgggggacggccccgttcgccaccgcgcccggcctcgaaatgccgctgccgttgcgcgaacgcggccttcagcacgcggtcactccggaggccgagggctcctgggaacgctatgaggccgccctcatggacacgacccggcgagcgctgagtgaggcccaggtgggcgtcgaggacatatcccgtgtggtgatgcctctcatccaccgcggtgtctcacccgagaactacgaactgctcggcttcaccgagaagcagagcacctgggacctcggccgcctggtgggccacgtcgccgcgggcgaccagttcctcggcctcgaacacctggtcaagcaaggcacagtgggaccgggcgacctcgtcctgctcgtcgcggccggcgagggattcagctattccgccgcggtcgtggagatcctcgacgtcccgtcctggtgacagccggcctccgacagcgcggcgtctgcccccggtgtctgctccgagcgacggacgcgctctgcgtgtggcgggccgggaacgggcgcggcgaaggactacgtcacgggtgcgatcgcggcgggccacccgcggaagccggtctcggccccgtcgaccgcggccggcggacgcgcgcgggcgggtgagcccggaggggcccgatccgagtgcccggtgaggcagcgtcgtctcgggacctccgggcccctggggcggaccgctcaacggtcacacggtgaagcggtggcttcccgagccgacctcgaacaccgcgcagccgtcctccgcgcgcacgaacgttccgtgcgtgtgctggacgcggtcggggtgatccgccgggatccacacctcggcggtggtgttgggcggcacgctgcacgtcagcacgaagccgccggaccgctgctgccaccgggtcgacaccggaccgtggagagaggcgaacgtggcccgggcggaggtgacttcgccgcccgggcgggggcggatgacgacctgccggtaacccgctcggcccggagcgatgccggcgatgttggcgtacatccattcacccaccgagccgtaggcgtagtggttgaaggagttcatctccggggtctggaaaccgccgtccggctggatggagtcccagcgctcccacatggtggtggaccccttgtcgatcgggtacccccagctggggaaggtgcgctggtgcaacagccggtaggcgacatcggtgtgaccggtgtcggtgaggacgggcagcagccgtggggtgccgaggaagccggtcgacagatgccagtccttcgcctcgatgagggcgacgagacggtcggccgccgccttgcgcagggcgtccggcaccaggttcatggacagcgtgaggacgtaggccgactgcgtgtcgcccttcaccttgccgtcggatgcgacgtacgccgtctggaacgccttgcgtatgcgggtgaagaggtcggtgtagggcgcggcgtccttgcccaactccgttgccatccgcgctgccaggtcggcgctgtgcgcgaagtaggcggtcgcgatgacgtccttgggcgtctcgtcggacacgttcagccagtcgccgtagccgtcggccggccgcagcaggccgtcactgtgcttctccagatacctcagccaggcgtgcacggacggcaaggcgtccgcgaggacctgtcggtcgccgtacgcctgatagagggcccacgggaccgtgacaccggcgtctccccagcccgcgacgccgttgccgaggttgcccacggcgggtgccacgtccgtgaaggcaccgtccgacgtctgcgcgtcgcggagatcgaccagccacttggtgaggaagcgggccgactccatcgtgtaggcggccgtcggcgcgaagacgttgatgtcgcccgtccagccgagccgttcatcacgggccggagtgtccgtcggaacggagaggaagttgccgcgctgaccccaagtgatgttgctgtgcagcttgttgagcatcggcacgttcgtctcgaactcgaacgtgaacggcgcggaggtgtgcatgacccgcccggtcacggacgtcgtcgacggcttgccggggaatccggtcacttcgacgtagcggaatccgtggaaggtgaaacgaggctcataggtctcctcaccttgtcccttgagggtgtacgtgtccgtcgccgcggccgaccgcaggttcgcggtgtagatcgtgccgtcggggttgaggacctccgcgtgccgcaaccgcaccgtggtgcccgcgtcgcccgacacgcgcagccgcaccgacccgaccatgttctggcccaggtcgaggacgaagacgcccggcttgggctcggtgacctttctggcggggagttctttcgcgatgcgcacgggaccgtccacctgcgcgacgatctgctccgggacatcgttgtcagcgccgcgcaccgcgagccacgcccggtcgtcgaagcccggtgaggtccacccggctgtctctttccgcgcgtcgtaggtctcgcccgacagcaggtcggcggacacgatcggtcccgaggcggcacgccagtcgggccccgacgtgatgcgttcactggtcccgtcggcgtactccacctccaactgggcgagaagcgccgggcgttccccgtactggtgcggaccgaacatgccgacgttgcccgcgtaccagccgggggccacataggcggcgagcgcattggcgcccgggcggacggagctggtgacatcgtaggtctggtactgcacgcgcttgcggtagtcggtccagcctggggcgagttggtcgcgtcccacgcgccggccgttcagatgcgcctcgtacaggccgagagccgtggcatacagacgggcgcggctcaccttcttgtgcggcagccggaactcgtggcgcagttggttcgcggcggacgcgaccggcgcgacccggccccacggcccggctccccatgcggcggccacctttgccgccggccatccgctgtcgtcgaagtccggctcgcgccagccgtcggccggctcgtggtccgtggacttccacgaggcgtcactgaagatcttcttctcgccggaggccgtggtgaggaccagtacgcagatccagccggcgggcccgacggaggcgttggaggcggagaccgccagggtgttgttgccggagtgcacgtggtccaggacgtctatgacggccggacgacgccagccctcgttgtcggcctccaggtccgtgcgcgccacctcggcgccgtcgacggagacggcgtagacgttgtccgcgctgatggccagcgtggccccggtgatgtcgtccggcaggtcgacggtacggcggaaccaccgggtggccgccggagcgctgttcgccggttcgccctcggggaaccagatccacgaactgccctccagggaaggggcctccgtgaggggcgcgggagcggagatccacttcgcggaccactgggacgcgcccatcaggccggtctcccaccacgagggcgcgctccactccgaggcgccaccgtcggcatcccacacccgcaccgaccagaagtagcgggtacggggcttcagtggcggaccggcgtacgggacgaggacggaatcgtccgagacgaccttgccgctgtcccacacgtccgggtgggacaggcccgcggcgctcgatgcgacacgcacttgatacgcgctctggcgccggcccggtgcggccgaggccatcggccagctcaggcgcgggtgggccgcgtccaggcccagtggtcgctgaacgtattcgacgctcggagaggtgactcgcaaggcactcatgcccgcccttccctcggcagacgtgggcgcgggcgcggccacgccgggtccggctccggcagccacggcgcccaccgtggctgcggcgcccgcgaggatgttccttctactgatcacagcggcccctagaggtagaaggtgaatcgattcacagcggtgaacgtagggggcgcacgagacgcgcgtcaatgagcgtgcgtagcctttgttcgccgacgatcaggcagcctgcgggaacggacggaggctgtccgattcggcggtgccgcactcggattgaaccctttcaattcgagtgcggcgccgattccagcacactcgcccatcccagtacgagcaccacgtacgcaccgccgtccgcctcgccacggtgggcagacggcggaggtcagccgagtacgggcgggcggtggccggcctcccccgtccagccaggggttctaggggttctacctgcccggctgaggcgggtcagaccttccaggtgcgcagttggtcggcgacggcgaggatgccgaggcgggtgtcgcggatcttgctgacgaggtcggacagggcgccgtagggcgggtcgatgccctcaccggactggtccatgtactgggcggcgatgaacgcggcgaacaggctgttgcggtgcgggagaggctccaggcgcacgatggtgtgcatcagcgcggccgcccgccacgcggcgtccgggtcagctgcggcgagcgtcggcagcttggtcttgtggcgggcgatcgccgccacaagcgcggagtagtccgagaccgacatgtcctcacggccgagggcggcctcctggacgtcgagcagccaggagacgtcgacatagaagtgcatcaggcggccgcggccccgtcccggcgctcggacggcggcacctcgtcggcgaacgcgtcgtcgaactcacgccgcaaccggtcggcccacgcggtagccccagcgacgaactgcttgcgctgcatctcgcggacgccgaggtcgtgcaggtactgcttgaggctcttgccctcggccgcggcagccgcgcgcacaccctcgagctcttcgtcggtgaaggacacattcagtgatggcatacatcgatggtacctagttggtgcctggggcgtcaggccccacacggtcacggcggggacaccgagagaagccgacagccccgccgccaccaaaaccctcctcgccgacaggtgtctcacaccccactgcacggccctcggaccccgttgatcaggccgttttccggaggatcagccgggtgggagtgatgacacggtgaagcgagtggtcgccatcgtccaggggcgtggccgggatccgttcgaacagcagacgcgccatcaggcgtcccatgccctcgatgtcctggtgcacggtcgtcagtgacggttcggtggtctccacaagtggtggcaggtcgtcgaaaccgatgacagcgacgtcctcagggaccctgcgcccgtgctccttcagtacgcgcagcgcgccacaggccatcaggtccgacgcggcgaagaccgcgtccaggtcgggacaccgggccagcagctcggccatggcgtccaccccgccccgcaaggtgaagtcgccctcgacgatcagatcgggtgcgctgtccggcagcacgtcccggtagccgtcgagccggtcgaccgcggccgcctggttgagcgggccggtgatggttgcgatgcgttcgcgtccctgcgcgaccagatggcggacggcctcccgggctccgccgcgattgtcggcatcgacgtacgtgtaccggtgaccgcggtcctccgggctgaggaccgggcgcccgccgaagacggcaggcaggcccatccgatcgaccatctccggaagcgggtcgtccccgcgcaacgagaacagcagtgcgccgtcgacgtgcccgccgcccaggaagttgcccacgcgcgggtagtcgtccggctcctcgatcagcagcagcaccaactgcgcgccctggcggacgagttcttgacggatgccgcgcaggtgccggtcgaagaacgggtcgacgaagaggcgattctgcggctcggtcaccacgacagcgatcgcgtcgtttcgccgggtgaccaagctccgggcggcctggttgggcacgtaaccgagctcggccaccgcggtgcgaacacgttcggcgaccgcggggctcactcgcggcgagccgttgatcaggcgcgacacggtggaccgtgacaccccggactgccgggccacgtcctcgagcgtggggcgttgtccttgggaccgtccggtcacatgcgtcctccgatccggagcagttcttgcagaacctgctgggcctggtagccgtcctcgaagtctgccagagttcccgatctctgggatgcggttacggcaccggcccagtcgtggagttggtcgaggaaggagtctccccagccggtgacttctccccgtggatcgtcgagccggctgggcccgaggagcttcacctgctcccagtcgatcccggtccgcagatgaaggaccggaccgtcctgcgagtcgtgggaaaggtcgccgcggcttcccatggcagccagcgtgaacccggtctcttcgggctgtgaggccttggaagcggtcagcgtgaaggacgggccgccctcgatccggccgctgacgaaagcatgatcgtccacctccacggcgtgaccgcccttggcggcgaccttcgtccggagcgcgacttggcagctcgcgagatcgacggggctccggaagaggtgatggagcatgtcgatcaagtgcactccgaggtcaccgagtgcgccactggtatggccttccgccgcgctgtcgcgccaggtgaagtgctgacgggtgagcgcgctggcacgtttgaaagcgacgtcgacgtggacgacgcgtccgagcatcccttcaccgatgcgattgcgggcttctcggatcacgttgaggtagcggtaattgaatcccacggcgcacacgcctggtgcgaccgcggccagggcgcgcatgtcggccgcttgcagcagggagactgccatgggcttctcgcacagcacgctcctgccgtacgcgaccgcctcacgcgcgtagtcggcatgtgttcggttcggcgaggcgaccaccacaccgtcggacgccttgtacagctcgtcgggggacgcgaacgccaccgttcccgacgcgcgggccaaggactgtgctctctcccggtccaggtcgaatacgcctgtcaataacgtgttctcacaggccgccaccgcttcggcgtgcatgtggccgatgttgccggcgcctatgattcccactcgcatcacggtagaacccccctgagctcggacaagattgcgtcggcgtgagatctcgcggacacctgcggataccgggctcgggcctcctcggtacagttcccgaccagaagtccccggccgacggcggtgagcatctccaggtcgttgccgctgtccccgaaggcgaaagcgtccgcctcactcaccgcgtacaggcggcatatgtactcgacaatgtgacgcttgccgcagtcccggggaaggaagtcgacgtcatagcagtcgtccggatccccggcggccggattgcagcggctcaggttcacaccgagcgagagcctgtccgcggtgcgcctgatcagagcgagttgacgagcgtcccgctcgggatcctgcgcgaagtagtagtaactgatcacgcggctgccgggagcgcgacaggactgtggaacgagcggcactccccgcgtgcgcagttcccggaaggcctcctccgcaaggccttccaagtgctcgccggtggtgagcatccgccgttgccagcccggctccggctgtatccccgcctcgctgatgacgtgcaactcggtgccgagcgagcaggctatgaagtgcggcaggaaacggaggccgtgccgacgggccttgcccagcacggacgacaacgagctgccggtcacccagccgaacagcagcccgtgccgctcgccggcgtcctcgaggtagttctccagcgcttgccgagaacgcacctgttcaggtgtgccgctgtgcgccaggtacgtctcgtcgaagtcggagaacaccacggtccggacggttgacgctgtcggcagcgggcctatgtcagtgagcggtggcacggaatgcggcatgcagggcttcgatcactcggtcctgttcggagagggacagattgttgtgcagtggcaggtggagaaccctcgcgtggacctgctccgtcaagggcagggcgacgtgtgcgaaatgcttgcggtgcaacggtgtctgctgacggtgggtgagtacggggtagtagatgtccgtctccactgcgtcagccgtccgcatacgtgcttggattgcgtccctcgcctcccgtccggcggctacctgcacgccaaacagatgccacgcgtggtcgggtgtgaaggcgggcaggacagccgtgccatctgccgcgagctcctccaaggcgtcgagatagcgcttggccaggaaggccctgcggtagctgttcagggtcaggcgtggaagaagcccgagggcgactgcggcggtcgagttgtcgatcttggcgttcagaccgaaggcatcctccttgacattcttccgctccgggtcgaagccgtggtaggcgaacctccgtgccgatacgccgacttcagcgtcacgggtcaccacggcgccggccttgccggtcagtccgaagtttttgtacggattgaagctgagcgcagctgcgtccgagtgttgtccgactccggtgacgccgatggcctggcacgcgtcctccacaagacccaggccgtggcgacgggcgatctccgcaaggcccgggacgtcggcgaagcggccgtagagatggacggggaggatggccctggttctgggagtgatggcggtctcgacgagagccgggtccagagtgtggcgcacggggtcgatgtcgacgaggaccggggtggcgccacaggcccatacggcgttctcggtggccgcgaagctgttcgcgggcatgatgacctcgtcgccgtggctgacgccgaccgctcgcagggcgatgatcagggcatccgtgccgctgctggtcgccaccgcatgcggcactgcgaggaactccgccagggcgtcctcgaactcgcctatcgcggatccgctcgtcagttcgccgtcggccaccacgcgggcgaaatgttcgacggcgatgcgttgttcgtcccgcgtccacagccgcgacttgggcagaaagggcaccggatcgccggccgcacgacggggatccacggcgaagacggagtcggggccggacggatcgagccgcccgacgtcctcggccagggaatcggacagggctcggttggcgaggctccgggagcaccggtacaccgggacctcgtgccgccgcacttccccgaccaaccggtggatgcttgtgctgtcgccggtgaaggagtcgttcaggaaggtggtcatcggcgtcttcacacctcggccgcatacttgaggagcgcagcgcagccgaaggacttcgctgcctgctggagcagctccgggctgggctccttgaagtagagcagttcccgtcctgtccgcatcgcctgtacggccgtcggcagttcccggtcgtccgtgatgtcgacgacgatcaggtcgtgcgccgccccgaccctggcgatctctcgttcggcgctgtccagattgtccgcgtcgacgaccaagacctcgtacgagtgcccgatcggcagtctctcggcgaccgctcggcacgcgaactcgaagcggagataggcgtcgaaccagctgggacggctcgtgcgaccaggatcgaagtaggagtcgagcacccattgcagcctgacttcgagttccgggtgcttcgaagtgaagtactcgaagttttcccgccagtccgcgtagcgctcctggtccgattcgggatgaaactggtgatatacgcgggaatacaggttgtgaacgaaggccaggccgcgtcggtgcagacgatagccgagttcaacgtcttcgaagctccacttttgtatgttctcgtcgaacccgccgacggccagcaggtgttccttgcgtacggagacgttgcagccgtagaagaagtgccagccggtggcaaggttgcccatgttctgcgacagggtggcggtgacctgggcacgctcgtcctgatcggcgaccgggggaaaagcctcaggagtgaaagagcgttcgaggagggcgagatcgacggctccgggcgcctggtagtcccggaagccgatggccacgatcgcggggcgaccacggtgacaccggatgtgctcttgaacgaagagcgggtcgatgatctggtcgccgtcgacgaagacaatcaattcgccgtccgccgcacggattccagcgttccgcgctgcggagcggcaggacttttcggtacgcggcacataaacgcgccggatccggtaggtgagcggcagcgagtcgacgacctcgccggtgccgtccgtcgaaccgtcgtcgaccaggacgacctcgaactcgtcggcctcatcgagtcgctgatgattcagggacaccagacagggagcgacaaggtccttcgagttgtaagtggggatgacgaggctgactttcacacgattctccatggaaatataggagctgacggcagcgggttttcagcttccggcaacgggagcgctcttcggcttccccacgatgcgatgggccctttggggggcagagatgtgtcgccaacggatgctgagcaggagggctcggagattctcgtcgatcgccatggcgatcatgacaccgatgatggcgaggccgagcggcagcgagagggcgtacgccaggggaatgaagactccccaaaggacgaggattccgacggcggccggataggtgacatggccgacggcgcgcaacgtgctggccgtggtcatgatcagagaggaacccggaagatagagcaagccgcaccacaggagtaggcgtccggactccgccacctccggggaatcggtgaactgatccatgatccacccgcccgacaggccggccagaagcgccagggtgagggccacacccacccccaccagccgtgtcgttctggtgatgcgtctgatccggtccagttcgccggcaccggcaagatggccgaccgcgatctgcagtccctgcgaaagcgccgagccgaacataccgatcatgttggtgatactcagcgtgtacatgcgtgcggcaagctcatcggggcccacggcggcgatgatgcgcgtggtggtgatttgggcggcttgccagaacgccggctccagcatggtgggcagggcgaacgccatgagcaacgcgccgtgctcccgcagccgctccgcactcggcggacgccgaaaccggatccgaattctgaagaagaccagccacgcgctgaacagaagtccggccgcggtggcaagggctgtggacaacgcgattccgcgcacgccccagcggggccctgccggaagcaggaccaggaggtagatcagcacgatgttgacgatgttcgtgagcactgcggcgaacatgcccgctcgggtgaatccgttcgccgccatgacaccaccgaacatggccaccagggagtgcagggcacagcttccccccacgacttgcaggaaggtggtgccataactcagtagcggccctcgcaggcccagcagctgcgccatctccctggcccatatgagcaggacggcgctcgcgaccacacccagcagaatgtgcaggagcaaggctactgaatagcattcctggacttttcggtgtttcccctgtccaagcattctggcatacacgaggctgccgccctgccccagaaaggagaacatcatcaacacaaaggtggtgactgtgttgacggatccgacggaagccgcggcggcgtccgatatacgccccagggcccaggtgtccacaagccccatgcagtaagtaaaggtcagctgtaggaaaatgggccagctgagagagaaaactcctaaattcacctttggtggcacgatgacgtttctctccgctcccccagatcccccgcagtgattctcaccttgagaatccagtggattgcggttccaccgtctgcgtcgagcaactcgcgcccgccccactgatcagttggatgctagccacccgatccactcggcgggaagagccgactgcatcgacaaaccggcacccacccatttctcgtcaaggcatcgacatcccctgtgcgggagaaaaccacttggagtgacccgcaaacagggaaaatccgccctgaagtattcgatcgcatggatgccctgcagagcacagcgtgacgaaaggggctggagtggctgttgtggtgtggccgatctacctctgatctcggccagtggtccgcccttcaggactctgctgaggattccgcgtgctcgaagcggatcaccccggagcgggcaccaccgcgaactcgttcgcctgactcaacagcgctaacaaggagccggagccgtacttcgcgctcaacctcgcgggtatgcgcgcacactctgagttcgccggggacggcgcgccgtggttcttcccttccgggaacctggagtgggcagtgacggaccggcacgaggacgccgaagtcaccgaagtagcggtgaaaccccagtagcctcctgcctcgtcctgggcggtcacgatcgtcaccgccgccgcgagccgtgacatcgcctctctgaacactcgggcgtccggcactccggaggccggcaggtggtccgcgtgacgccgaggcgtggtcacgacgcgtcctgcgccaccgtggcgtggaccgggagacaggtgagaccgagcatgaagttggagcggaggcgggccggcgggccggcgggttcgaacgtgatgccccgccgcacgatctccttcaggagcaacgcaatttccatctgcgcggcacccatcccgatgcaccgatgcacaccgaccccgaaggcgatgtgccggttgggtgtgcggcgtacgtcgaatcggtcagggtttgggaacttctcctcgtcgcggttggcggacgcgttccacagcgtcaccggatcacccgcgcggatcagttgaccgtgcaactcgacgtcacgtgtggcgacgcgctgcacgtaggcgttcgtcgacgtccagcggaagatctcctccactgcggtcggcaggagtccgccatcgtcgagcagccgttgcgcctggtcgggaaagtccatgaaggcctggacggcggcggacgcggtgaagggggtcgtctcgttgccacccaccgccacgttcaggcagttgtacaggacctcgtcctcggtgaagcgacggccgttgatcgaggctcccagcagaatgctcaccaggtcgtccgagggggcgcgtcgcctcgtctccatcaggtccatcatcacgtcgaagatctcgacttgggaggagaccagcaccgccggcggtgtcgagtcgctgtgataccgaggatcctggaatccgatcatggagcgggtcagtgcgaggaggtgcagggcgtccctccgctccaggccgaacatcgccgccaaaagcccggccggcagttcgggtgcgacgtcggtggcgaaatcaccgccgccgtccttcagcaccctgtcgagcgcggcgttgacatagtcgcgtacaacgcgacgggcccggtccatgagagcgggcagaaaggccctgtgcacctgctggcgcatcagccggtgctgcgggtcgtccgaggcgatcagcatacggccggacgcggagtccgcgtccctcctgtgcgacccgcccatcaccgtcccccaccgggacgagaacaggcccgcgtcgacgtaggcgtcgtggacgtcctgataacgcgtcagtgcccaaaacccggacggccccacgccactggcggtgtcgccgccggtggcattccagtggacggggcgatcacggcgcaggactcgccatgcctcgtgtgggtccccgtcggtgaacaggtcgaggtcggcgaggtcgatcaccatggccgtcatggtgtgagcgcctccttccgcagcccgtcgatcaggcgggcctgttcctccagcacgctgtgctcgaagagcgcttccggggtgaccggtacgtccagttgccgccgcagcaacagacgcacccgaaccgccaggagggaatgtccgccgagcgtgaagaagtcgtccaggacgccgaccgactcgacgttgagcaggtcctcccagatcgtggcgagaaaacgttcggtgtcggtgcgcggggccacgtaccggttgcgccgggaggcatgatccccgagcatgtccgccaggcggtgccggtccctcttgccgtgggcgtccgtaggcatcgcgtccaagacgatgatctccgccggtacgagatgagccggcaccgtggccctgaggtggccgcgcagctcccgcagcaggaagttctcccggccgacgaccacgaaggccaccagccgcttctcccccggttcgccgtcgctgaggacggccgcctccgacaccgcctcgtagcggcacagggcccgttcgacctcctgtggttccacccggtgacctcgaatcttcacctggctgtccgtacgccccaggtactccagcgcgccgtcctcaccggagcgcacccgatctcccgtggcgtacatccgcgtgccgtcgccggcgaacgggtcggccacgaatctccgtgcggtgagccccgggcgcccgagatagccacgcccgacgcctggcccacccacgtacaggtcacccggcacgcccgccggcaccggccgcagccgctcgtccagtacgtggagccgggcgcggccgaaggagtggccgatcggcacctgctctcccagaagcgcgatgtcgatcacggggaagccgctgcacgcgacggtggcctcggtggggccgtacaaattgaacagctccccggtgaagccgccctcgcgcagcgcacggcaggtcgcggggagcaggacgtcgccgccggaacacagcaaccgcagtccagacagagcctcgcggtcgtgtcgggcaaggtggttgagggcgatggcgggggccaacatggcggtgatgcggcgtcggcgaagctccttgccgaggtcggtctccatcagctccgggatgcccggcaccacgacgacctccgctcctccggcgaaggaacgccacacctcgaaggtgaaggtgtcgaaggagatgctcgacgactgcgctgtgcggtcccccgggcgcaggagcggcaacgtgtccgcgagcgcgaagtcgaccatctgtcgatgttccagcaccaccgcgcggggtgttccggtggagccggatgtgaagagcacgcaggccgcgccggcgggctgcgaaggcgcgagcgacgccggcggtacggcggcccggccgtcgacatcaccgcaggacccgtcggcggccgggccactcggtgtggatggccactccagcacggacagacctgtctgcgccatgcgttccacccagccgggggcgacgagcacgtgggtcaccgcgccgtcgcgaagcatctggtcacggcgctgtgcgggatacacctcgtcgatgggaaggtaggcggcgccggcccgcaggatggccagcacggcgacaaccaccggtactccccgcggcatgtggaccgcgacggtgtccccgggggacaccccgcgcgcgatgagctcgcgtgccgatgccctggtggcttcttcgagttcgcggtacgtcaatcgggcgtcgccgtcgctgacggcgacggccgtcgggtgccgcagcgcggtccgttcgaacagttcgctcagcgtgctgggcacgtgcgccttcatggtgcgcctccggtggtggtggtcgcgccggacagcgcgtcggcgaactcgtcctccagcacacgggtcagtgccgtgggcgcggcgagatagctgagcttgccgccctccaggacccggtggcgcgtgttcccgtacgcgttccactgatgcatggtctcgggtgacacttccgggtccgcggtccagccgatggccgtcagcgggctgtgcaccggacgcggcgccgggatccggtagccgtagcacagttccacgtccgccctcaggacacgcagggccagcgggagaagctcgggcagaatctctcctccgcccaacgcctgcgacacgtggttcagttcgtcggcgaactcctcgtccgtcatggacgggtggtagatgccgctcactcccggctccggagcacggtatcgccgctgtgcgtgcaggtgcggcgcggcggcggacgacaccacgagcagggtcgcccggggcagtcccaggtcctcgatgcgggtggccagcgcgtgggccaacagggcgcccatgcagtgtccgaacagcacatagggccggtcgagatgaggagtcagggcctcggcggtctccgcggcgaactccggcacggtgcgaaacggggtgtgccggatccgattctcccggccgggcagctgtacagggcatacctccagcggcccgatccgggtcggccatcggcggtacgaggaggcacccgtgcccgaatagggaaggcagaagaggcgggcccgggcctccggcgagggcggcctgagcagccaccgtccggtcgattgcattgctgtcctccaacaggctgtacgcagacgcgggcgccttggcgagggcgccgagcacgcggtgcgggccgcccctgagatgccttgcgagggctttgcgcaccgcggttgcgcagggcggtgcgcctaggtcagtgggcggcgggcgtgccggacgcgacccggtcgactgtcgcgcggaagccggccaaggccgtgaccgggtccgtaccgtcggcgaagaggcacgagttgaccaggaccgactggaagccgagcgcgaaggcctgctcgacatcggcggtggagccgataccaccgtcgagcatgaccgggaccggactgtcgacgagcatctcccccatcggttcgaggtgctggggctcgatgccccgtcgagccccgatgggcgatcccatcacccgcaccatcgtgctccccagttccacgcactgcgcgaaggttcgggcgtcgggtgtgatcagcggccacacctcgaacccgtcggcggtcagttcccgggccgcttccaccacttcggcgttcacactgagcttgaagccggggtcgaggacttccagcttgatgacccggataccggtcaactgggcggcctgacgggtccgcttgaccgcctccgccgcgctggtggggtggttgatgttgaggacggggctcaaggccagttcctcaccgacgagcgccatcacggaacccagcgtcgccgtgtcgtagcccacgggcagatcgtcgcccgcggtgacctggtcgatggtgtgggtgttcacggcgagatgtcggcagccgctggcgcgcagcatctcggcggccaaagaggtgtcgacacggtgggcgggcttggcaccgaagcagtggaaaaggtcgatcacgatactcctcggaggcgcgaagtggatggggtggggcgagagacgggggtgagccaggagggacggtgcggtccgtcgcccaggacggcctcccgataggcgcggctcagcgcgtccgtcacgggacggccggccgcgtacgtgtgggtgtcgagacccgccacggacaccaggccgctcgccgtcccggtcaggaacacctcgtcggcggcgagcagttcaccgggctgcacgggtgcctcggcggtctcgatgcccaggtctccggcgagggtcaggacggtgtcgcgggtgatgcccgccaggacgctgtcctcgagccagggcgtcaccaggcggccgtcgcgaaccaggaagacgttggcgatcgtggactccgcgaccctgccggagttcgggtccaactggatggcgtcgtcgaatccgtccgcggcggcgcgtgtgcgggccagcgcggacaccacatacgtgccggtcgccttggcgcgcaccggaaaggtgagctgtgacggacggcgccagggcgacaccgtgacccgtacgggtcgggacggggtgtcgtcggggggaagggcccagatctccgtgccgagagtgaagtggaagtcccggagattcacgccgaggcgcggctctcgggtgtaaagcacgggccgcacgtaggcgttgtccagtccgcttccggcggccgcgtcccgcacgtgccggcgcagggcggccaggtcgtaggcatgcgggatgcccagcagggccgccgagtccagcagccgctccagatgcgcgtcgagccggaacaacaccgggcctgccggcgtcgtgtacatgcggatgccttcgaagacggccgtgccatgttggacactgttgctcccgaacggcaggtcccgctcctgccacagtccgtccatgaccgtggtgtgggaggctcgcgtggtcaccatcgggcccccacctccgagggccggtcggccgccgcgagcacggctgccgccatgaggtcctgtcggtcaaggacggccgcgtggtcgccggggagcaggcgtaccgaggaaccggccccgcccaggcgcggccacaccgtcacatcggcctcgcgggccaaggggtcctcggtaccccccagggcgtgtaccgggcagtccaggaccaccggacgacgtgggtggctcgccacggcggcgcagtccgcccgccacaccggcaccatcacggagagcagctcagggtcgtccaggaccatgctgggcaccgtgccctgcgcggccagcgccgctgtcagttcctcgtccggcagcgtgtgcacggcacgtccggccagcaggtgaggcggtgggcagccggcgacgaccaacccgcccgcgccggtgccgcgttgctgcagccgcgccgccatctccgtggcgatcagggcgcccatgctgaatccgaacagcaccagtcggtcgggggaacgacccaggccgagctccgcctccaattggttccacaggtcgtcggccagatccgtgaagcgcgccgcggcggtctccgcgaagcggctgtcgcgtcccgccagggcgggcagatgacagtgcccgtgctcgcgcagttccgccaccatccgggagtacgcaccgcggccgccgcccacgggcgggtacagggcaaaccagctttcggtcacttgggcgcacccgccgtttcgcgcagcgcgacacgcagccggcccagctcctcgacgctctccaggacttgttcgcgcggcagcccgaagtccacgaggcagccgagttcggtgatgccggcggcgccgagccgctcgaccttcggcaggcagctctccgcactgccgaacagccccgaggtccccatgtagcggcgcagcccgtgctccaggagcgcttggcggtccgcttcggtcacctcgtccgggtcgatgccggcacccccgcccgcggcgtacttgctgaacaggtccatgtgggcggagagataccggatcagcgggccgcggacgcgctgttcgacgctggccgggtcggatgccaggtgggtgtggagcatgcaggtgacctggcggccgtcggtggggtgccctgcctcggtgagcgcctggtggtagagaccgaccctctcggtgatctcgtcgatcgtctgctccagcagcgcggtcaggacatgcaggttgagccggcccgccgtgcgccaggtgtcgggattgcgggaactggtcagccacacctcaggggtgcgttccgggcgcgggtaggtccgtacctcgacaggacgtccgcccggtcctttgcgggtgatgcttgcgccgttccacaaggtgtgcaggtctgcgagcctctcttccagtacgtccttgcggcgttcgtagccctcggggttgaggacgaagtcgtccgcgtgccagccggaggcgagggagatgcccatccgcccccggctgagcgagtccagaacgccccattcctccgccaccagcagcgggtcgcgcaggggcagcacgacgctgccggaacgcagggcgattcggctggtgcgcgccgcgatggcggccagcaggaggccggggctggggtagggggcgccgaaggggtcgaagtgccgctcgggcacccagatcgcgtccaggccaagggagtcggcgagttcggcgcactccagcacgagggcgtgtttgtcccaggcgtggtcgtcggtgtcggcggagaagaagaacaagctgaccctgggcgtggactccgcgccgttcgacggaatgcccgccgcgggggcgccggcctcgggcgccgggccggcgaccggcaccgcgcggtcgggggtggcaaccgtgtgcggtgtggtcgtctcgggtgtcgccgtcccgttggcgcgggtgcgctcgcgcaggagccgttcggccagacggcggcgctcgggaccgagtgcgtcgagggaggatcgtggggtgtccgtcgtcatgcgccggtgtctccttccagctcggccagccgggcttggacctcgtcgtcggacagggcggcgacctcggcgagcagggccgccgtctcctcgtcgtcctcggaggtccgcgccgcaccgctgtccggcacgggtactccgagccgttccaactgctcggccagacccacgaccgtgggcagttcgaacagggtggtcatctccaggccttcggcaccttccttgcgcatgcgcgtgaccatctgcatggccatgagggagtgcccaccgatctcgaagaagctgtcgttcagcccgaattcgtccgtgccgagcagttccgtccacagcgcggcgacgtagcgctgcgcgggcgtggtgccgatctccttgcggggcgcgggcttttccggtgtggcctgcgcccggggggcggcctcggcctgctcggtgcgtacggtcttcacgggcagcgggtcgagccagtgccgggtccgggcgaacggatagagcggaagcgacaatcgaaggcgttcctcttgggcgtagaactcgctccagtcgacgtccccgccctccagccagaacccggtgagcaggtcgagcaggtcctgtggctcttcgccgccctctcccgcgagcgttgtcagggaggccgcctgcgttcccagaccggcggccaggcgggtcagcgtgtggccgggtcccagctcgatgaacacggagaccccatcgcggacaagggtgttcaggccgtcgttgaaccgtacggtgtggcgcagctgtcgtccccagtagtcgccgtcggtggcctcctgcgcggtgaggtacccgcctgtgacgttggagacgacgagtccctgcggcgcgtgcagctcgtgggagtcggcggcctgccggaacgtgtccgcggccgtgtccatcaggggcgagtggaacgctcgggtgacctcgagccgcccgcaggagacgccgtcggcgcgcaggcgggcggccagttcctcgacctcctgtggcgcaccggacaccaccacgagctgatcggcgttgaccgcggccagggtgagatcgccgggcacgtcgtccagcagcttggcggcctcttcctccgcgaggttcacgtacagcatggcgccctcgggagtctcgctcatcaaccggccgcgccgggccaccagttcgacggccggcgcgaggtccagtactccgccgagcgtggcggccacgagttcgccgacgctgtgcccgagcatggcgtagggccggacgccgtagtccatgagggtgcggccaagggcccactccaccgcgaacagcgcgggttgggtgtactcggtggcggtgagggtggttcgcgcctcctccagggtggacgcgtccgggcgcagtaccggcagcaggtcgaccccggcgcgctcctggaacagaccgatcacgcggtccaggtgggcggcgaacaccgggtcaccttgcgccagtcgggcccccatggccggaagctgggttccctgcccggggaaaaggaaggcggtgcgcaccgatccgcgtgcctgcgcctcgcgttggctgcgactgccgcgtgtggacagtccataggccacgtcgtccaggtcgtgggcggtcagggcgcggcgcagcgggagttcacgccggccggtggccagggtgtgggccacgtcggccacgtcggcgtgcgggttctcccgagcccactgccccagtgactggctcagatcctccagcgcctcgccggacttcgcggacagcaggacggggtgacggcgccggcgtgaggccccgccggagcgcaccggcggagcctcctccaatacgacgtgggcgttggtgccgcccatggcgagggagttcaccgatgccagcagcggttcgtccccctccaggcgggtcagttcggtcgccacccggaacggcgaggagtccagggccagtttggggttggggcggcggaagttgaccacgggaggaaccttgcggttcttcagggagaggacggtcttgatgagaccggcgatgcccgcggcggcgtcgaggtggccgatgttcggcttggccgatcccaaccagcagtacgaggtgtcctcggtccagtcgcggaacgcgcgggtgagcgccgccacttcgatcgggtcgcccagcggggtgccggtgccgtgtgcctcaaccatctggatgtcccgcgcgtcgactcccgctcggcgcagcgcacgcgccacggcgcggctttgcccgtccacgctgggcgcggtgaaactcgccttcgcctgaccgtcgttgttgatggccgagccgcgaatgacggcgtggatctgatcaccgtcccgcaaggcgtcggcaagccgcttgagcaccaccactcccacgccgctgcccactacgctgccgccggcgtcggcgtcgaaggcacgacagtggccgtccggggaggaggtgccgccggggttggcgagataccccgcggcgtgcggcatgcgcaccgacgcaccgcccgccagagcgatgtcacactcatcgtcgacgagggctcgacaggccatgtgcacggccacgagcgaggtggagcaggcggtctgcacggcgagactgggtccgcgcaggtcgagtttgtgggagacgcgggtggtcaggtagtccttgtcgttgccgaccatcgtctgcaggtcaccgaccaggccgaccacgtcctcggcgtgcggcatcacgttgtgcaggatgtacgtgttcatggtggagccgccgaatacgccgacgagggcgtcgtcgcgcctgctgtcgtaggcggcgtcctccaacgcgtggtaggcgcattcgaggaacacccggtgctgcggttccatgatcgacgcttctcgcgcggcgtagccgaagaacgccgcgtcgaagcggtcggcgtcctccagcggtgcggaggcgttgacgtaataggggtcgtccaccaggtctcggcgggctccgttggcgagcatctcctcgcggctgtgccgcacgatgctctccacgccctcgcgcagattgcgccagtactcggtgacgttgtgggcaccgggcagccgagccgccatgccggtgatcgcgatggagtcggggtgctcgtgagcgggaatccgagtcactgatcgtccttcactgtcgcagctgccagggtgtcggcgggccatcgcggtcgacgcgccgcaaggcggccaaccgccgggccaggtcgcgggggcgcgggtactcgaagacctcgtggacggggaagtccacgccgagcgcggcggagatacggccgtgcacccgggtcaccaccagggagtgggcgcccaggtcgaagacgttgacgtccggcgccacgtcgggggcggccagggcggccgcccaggcggcacacacggcggcctcgatctcggccggggaagcggcatccgggaggcgttgcgcatggcgctcctcggccagccgctcgagggcggcctcgtcgagcttgccgttggcggtggtgggcagccgctccaggaggaccccctgctcggggagcatggcggggggcagccgtgcggcgacgtgatcccggacggccccgaggtcgatgccggtgccgaccaggtaggcgaccagccgagccggggtgccgatgacgcgtacttccgcggacacgacacccggtgcgctccgcagcgttcgctctatctcaccgagttcggcccggtgcccgcggatcttcacctggcggtccgcgcgtccgacgaccacgaagacaccgtcgtgtcgtgcgtacgcgaggtccccggtgcgatagaggacctcgtccgtgtcctggcacctgacgaagcgttccgcggtcaattccggtcgccgcaggtagccgtcggcgacaccggggccaccgatgcggatctcgcccaaagcgccgaccggtaccggacgaccctgttcatcgaccaggtcgatccgggcggccgcggtggcgctgccgacgggaaccaaccgcggcggctccgctccttcgggcgggcggggtatttcgtacatcaggcagttcaccgtggcttcggtgggcccgtacccgttgaacagccggcagtcgggggccgccagaacgcgcatgccttccgcggtcacccccttgagcacttcaccacccaggaggacgagtcgcagatcgggcaacggctcgcccgcggcaatgagttcatcggcgaacgacggggtggtgaacaacaccgagacacgttcgcggcgcaggaagcgggcataggcccgggcgctgagccggtcctcctgaccgggcaccacgacgcagccgccgaacggcaggaaggtgaagagttcctgaagcccgaagtcgaagccgagggagagtgtctgtgccacccgcgcccacgggcccagttgccaggtgtcggcgcaccaggcgatgagccggccgatctgctcgtgtcggatgaggacgcccttgggccgaccggtcgagccgctggtgtagacggtgaaggccgcggcgtcggggatctccggtacgtgcgagcgcgaaggccctggggcgtgctcgtccccatccgctacggcgtccaggacgacgacctcgatggcgggctgcgcgactgccgcgaggcgggcggcacggtcggcctgatcggcggaggcgatcagggccgccggtcgacagtcctccaccatgtgccgcagtcgctcgtcggggaagtcgacaggcaatggcaggacgccgagtcccgcctcccacgccccgtacagggcgacgacgaagtcggccggagacgtgatcagcaaaccggcctgttgccgcgccaaggccgcggcggtcgagtcctgctcggcgcggacggatgtgccggcgaaggcggtcatgcggtcagctccttccgtcgtcgacgaggcgcagcgcgtgggcgacccgttcgacctgccgggtgaactcggcgtggctccacacctggtggggcccctggatcgcgggcgcaccgggtgtgtgctcggccaccgccctgacccgctgaagcagcgaaggctccaagggcggggtcgcgcaccgtccgatgcgttcgaggagtgcggcgtcgtggtcggacaggacggtgaggtcggcgagccgcgccccgtaggtccgctccgacgcggcgagtgccgcgcagaacgtgtcgagcaccgcacgggcggtccgttcggtgaacaggtcggcggcgtagtccagcgtgaggtggagaccttcgggaccgggcgtgaccaccaggtccaggtcgtagcggcagctacgcctctcgatggggacggttctcaacacgagtgtgtcaagggcgagttcggtctcgctgccggacagtgcctccagcaggcccctcacgtccggcagtgggttctcctggtaggtgatgagcgtctcgaccagcggtgtgcggccgggttcgcggtcgggacggacggcctcaacggcgcgggccagcggatacagaccggcgtccatgccggcggtgagctgggcgcgggctgcggcgaccaacggttccaggagccggtccggctcgacgtcgagggccagggggaccgtgttcgtgcacaaaccgccgatggccccgtggcgcccgccggtgcggccggtcaccggcacacccaccacaacgggcgccggcgtgccgtagcgccgcaaggtggcggcccacaacacggccaggaggctgaccgggtcctgacccgccggcccggggacggcaggggcgggcacccgcgcctcgacccgggcaccccggctgccgcggacggcggtgcgggggaagtcggtgcgcacgccgagcgacgcggcgcggcgtggcagcacctcgcgcaggaaggcgtcgcgctcgccggcttcctcggagtcgaggtaggcccgttgttctcgcacgtacgcgtcgtacgaccccggctcgggcaggcgcaccgggcgcccggcgatcagggcggagtaggcggatccgaggtcacggagcaccaaggacagcgaccacagatcggtgaccaagtgatgcaccacgacctggtagacacgccgcgtcggggtctgccaccgatacaggcgcagcagtggtccttgctcggggtcaaagggcagcgcggccgcctcggacagctgctgcgccagcctgtcctcggcgacgggcaccggcgtcagggcgagggcatcgcgcatgcgccgggtggacacgggttctcggcgtccgtcggccccggacgacgtgaagcggacgtgcagctccggttggtgctccagggccgtgcgcagggcctgttcgaacagatcgtggtcggtgcccggaccgggctcgcaggcgaaggagatggtgtaggcgtcgctgtcgggggcgagcatgtgcaggaacagcagggattcctgagccttggacagcgcgccggaggcctcgtcgcctgcccggaccggcgccggttcggcggtgccgacccgctccatcaggcccgcgacggtggcgccttccaagaggtcgcggacggggatgtccacgccggcgtggcgcgcgatcagttccgtcagccgtacggcgcccagcgagtcgaggccgtgcagggtgagcggccgatcgtcgccgacacccgtgccgagcacctcccgcacggcccggcgtacagcggctgtgggggccgtgtcgcccggagtggggccccggccgtggtcgaagcggtggtcggcgtagtcacccgccaggtaccgggtgcggcactcgccgcgtctcagcttgccgctggtggtcttgggcacagtgcctcggggcaccccgacgatctcgtgcggggccaggccgaaggacgtggcgatggcaccggcgatccgcgcccggtcgtcgtcggtcaggctttgtcccgggcgcagttccgcgacgatcaccacgccctggtcgtccggtgcggcgaacgcggcaacgcaaccggggcgcaccgcggggcagaggtcgacgacgagccgttcgatgtcctgggggtggtgattgcggccccgaacgatgatgacgtccttgatgcggcccgtgacgtggagttcgccgtcctggagaaagccgaggtcaccggtgcgcagccacttcttgtcgctgccgctgacgttcgcggcgaacacctcggaggtcaggtcgggccgattccagtacccggccgcgacggccggcccgtgcaccaggatctcccccacttcccccgcgggcagcggcgtgccgtccgccccgccgacggcgacctcgcagtcacgcggcactccacaggtgacgacttcctccccctcacggcagatgcgggtgctcgcgcccgcgcccacgggcaccgaggtcaccaacaacgtggattccgccagcccgtagcaaggaacgaaagcgtcgtccctgaaccctgccggggcgagcgcctcggcgaagcggcggagcgtgttggtggatacgggttcggcaccgctgtaggcggtccgccagccgctgagatcgaggccggcgggcagtccgtcgcggtcgacggtgcgggccacgagttcgtacgcgaagtcgggggcgccgctggtggtcaccccgtacgtgtgcacggcggcgggccatgccgtcgggttgcggatgaagtcgatcggcgaggccaggtaggcgtggcacccggtgtgcagggggtgaaggatgtttccgatcaggcccatgtcgtgatacgcgggcagccagctcagcacgacgctgtccgcggtgtgccggaacgcgtcgcggatggcggtcaggttcgccgtgagattgccgtgcgtcaccatgacgccgcgcggttcggcggtggagcccgaggtgtactgcaggaaggccagcgtgtcgggggccggggactcgctcgggacatatcggtcctcgccggtgcgccacaacgccggggtggcgagcgcatccgccacgtactcggccatgcccgcgtcggaggtccaggtcacccgggaaccgctgtcctgctggatgcggcgtaccttggcgcggtcctccgcggtgtcgagcagggggtacacggggaccgggacgcatccggcgtacaggcagccgacgaatgaggtgacgaagtcgagtccgggcggctggaccagcaggacgcggtcgcctggggcggcttcggcgagcagcgcggcggccaccgcggccgccgcgtcgtcgagttcggcacacgtgcgtgagtcggtgcggtccttgaggtcggtgagccaggacagcgcgacggctgtgccctctcgctcggcgcgcgcccgtatcgctccgacgaggtcgagcggggtcgatgtgcgtgtcaaccgggtctccctcatcgttcacctgctcgggcacgggggtcgggtcgctcgtcgggccccgtcggcccctcgccaccggccccggatcggtccaggtaggcggccaggtcgcgcaggcgtgggttctcgaacacggcgaccagggggactcgccggccccgtgcgcgacgcagccgtccggccaggcggatggccaacagcgactggccgccgagttggaagaagtcgtccgtcgcgccgacgggccggacaccgaggacgtccgaccacacttcggcgagcatgatctcggtggcgctctgcggcgggacatggtccggacgctcgcgttcggggtcaaggccgtggtccgcgggtggtggcagcgcggctcggtcggccttgcccgcggcggtggtggggatgcgatccacgggcacgatcgcggacgggatcatgtagggcggcagatgtgcgcgggcgacacggtgcagttcggccgcgccgggccccccgcgaccggggacgtagtggacggcgataccgcgcccgcccggacagtcgtcccgcaccgaggcgatcacctggtgggcgtccgtctcccgggacaacacgccctcgatctcgccgagttcgatgcggtagccccgcagcttgacctgcccgtcggtgcgcccgaggtactccagcccatccggtcccggccgggccacatcgcctgtgcggtacatgcgcgagccgtccgcggcgaacgggtcggcgacgaaacgccgggcggtcaggccggcccgggcgtggtagccgcgggcaactcccgtgccggccacgtatatctcgccggtctcgccctgacgcaccggccgcagcagggcgtcgaggacgtacacccgtacgccggggagcggggctccgatgtgtggctgcggcgcgtcggccacgggcgcggaagtcgcgtcgaccgtgcactccgtggggccgtacaggttcacggggatcaccccgccggcggcggccaggtcgcgcagcctggtccacagggaggggacgatggcctcgcctccgatgagcaaccgcaggggggtgcggcctggggcggggctgaagtggtcgaggagcggcgcgaggtgggagggagtgatgtccaggtcggtcagggagtgggcgtcgatggcggcggcgagttccgccgggtccgatcgggtcttctcgcccagcaggacgagggtgtcgccgcggaacagccgcagccactgctggacggacgcgtcgaaggagatgctcgcgttccagcccacgcggcccgggggcgttcccgtgagcatgccgcgctccagggcgtccaacagtcggggcagggatccgtgttggacggccacgctcttggggcgccccgtcgagcccgaggtgtagagcgtgtacgcgaggccggcggggtgctgcgggagcgcccgcagatccccggaggtcgtggagggcacggagagccgctccacgcgcagcgcccgtgcatccgaccccgtgggcaggcggcccaccgtggtggagtccaccaggacgaggagcgccccgctgtccctgagcgtgtaggagagccgttcactcgggtgggcggggtcgagcgggagataggcggcgcccgacttcaggatgccgagcagcccgacgacgagtcccgtgccgcggcccagacacagtccgaccacggtctcggggcccgcgccgcgggccgcgagggcggcggcgacggcatcggatcggcggtcgagttcggcgaaggagaggcgtccgtcctccgcgacgacggcggtacggtccgggaagcggaccacgcatgcctcgaaccgctcgtgcaaggaagcccggttgtccggctgtgtccggggctgcgttccaggcggtggggagtacgcggaggggacctggtcgaccgtcgcggcaacggacgccgaatcagtcatgatgctcgcactcctttccgaaggtggcccgggtcggcgtggatggttcagaagcgaaagcgagccggtgccgagtcgagcgcgcccacggcggctgcgaactgccgctccagcgaacgcagttgggaggtgccgtccgatccgccggtgtcgcggacgcgcatgatctgctcggagagctgcaggatcggggtcagctcgccgacgccgacgcctttgcccgcgaggtagggcagcgaccagaagtcgaagtcgtacagcgggagccaggtggagccggtgaccctgtcgaacatggaatcggtcaggtcggccgcctcgctcgaggtcatcgtggcgtggctccagctgtagccctcgccctcgatgccgagcgcctccttgttctggtagacgggcgagcgggggttggcccaccaggcctgcgccctccagaaggtcggcttcgtctcgttgaggaagtcgacggtgttgctcaccgtgcgggcgttctcaccgggaaacccgacgatgatggaggcgaaggtggtgatgtcacgttcgttgagccgttcgagcccgacgcggtactggctgtcctgagcgagcttgtgcatgttggcgagaatctcggtgtcgccggattcgattcccaggaacaccccggagcagccgctctcggcggccaggtcgaacgcttcctcgtcccgggcgttggagcatcggaagtaggagtaccaccgcagcccgaggtcctcctcgatcatcatgcggcagatttccttgaaccgcttgggcggtacgttgaaggtgtcgtcgacgaacacgatgttcttgacaccgagttccgccatggcgcgcagctccttgcgcacggtgtccacggacgccgccgccaacgcaccggcccttgaggggtagtcgcagaagctgcacttgaaggcgcagcttcgggcggtgcgcaactgggcggtgacacctatcagttccggggagaagcccgaccagtcgatggagctgtcgtcgagatcgttgctctccggacggcgccgggtcagttgccacatgccgtccgtgcagtggatgacgttgtcgacggcggagatgtcccgcccttccttgagggccagggcgagcctcgcgagggtggtctctccttgtgattcctgcacgtacgagtcggcacccatcgcgtcgaagaggtcttggacggtgccggtgatgccgttcaggcacaggttgtcgacgagggggccgccgatcacgatgtggctgtcgggcgagtgctcccggatgaactccacgatgggcacgaccggaaggatgttgacgtagaacgtggtggtgaccgccaccaccgtgggccgctgcgccagcaggtccgcgagtcgatcgcgctcgccgctgtagagcgacaccggttcggcgctcacgccgcgccggcgaagaaagctggtcagatacagcgccgcgaggttgaagacctctccgacgtgatagcggtcgtgccgtccggtgacgcgattgcgcagggtgctgaaggcgtccatccacggcatcggtcgcccgtcgacgaccagatgctccttacggaagatctgggactccggtgaactggggcccgcccgttcactcatgacccgatagtcgtcgaagtttccctcgttgtagccgatgaccacgcagtcgaggccggccatgcgatgcacacccccgcagttcggtcggggcccacggacgaatccgtcgccttcccgggcgcggtgccgggaacggatggaccgtacgcggggccggttgtacgggagttacgcgcccggcgccccgcgagatttcgccattgggccggatggcgtcacctgtctacgcttgatgatcactagaaggtcccgtgcctgctgctgcatcctcgttgaatggggagcgcaaccctcgcactcgccggtggcggccctcggggtgcgccggcacccgctgcgctggcggcgtaccccgtcaccggcgacgatcgggcgcgtgctcggggccattgccggcgacgccctggacgcagcggtggggcctacctcgccgaccggcaccgcgtggccaccgccccggcgggcctgcgggtcatcgcggtggacggcaaggcgcacacccactccggcaccgggcacggccggcgggaatcgcgcgcgatcaagacctgctcgatcgcggaccgcctcggcggcatcgccttcgcgcacgcgaaactcgccctgtgcgtccaccgccaccgaaggctcaccggcaaacgcgagacccgcgagagcatctacagcgtgaccagcctcgatgcccaccagaccagcccagccgacctcgccgcagccatccgcgggcactggggagtggaaaactccagccaccacatcagaacgtcaccttcgccgaggactcctccaccgtccacaccggcaccgcaccccgcgccatggccgccttccgcaccccgcgccatggccgccttccgcaacctcgccatcgacgccttcaaggcctcgaagccggcaacatcgccaagaccacccggaccatccgcgacgaacctgaacgagccctccggatcctgggcatcacctacaaccaggacacccatggaacttgatcaagccctgccctgttatagatccttgcatttgacatggacacatgcgtaacctcacttcggtcgccgactcgtacgagcttcccaattccacgcctggtcactacacggacatcctcgccgaatttccacgtccgctttcatccgagaccatcagctccccccactctcgtccccccatgaggagtcttgcgctcgatggatcacgcgatctcggtttacaccctcggaagtttcgaactggccattcacgggaaacccatccagcgatggaaggcgggcaaggcccgcgatctcttccagttcctgttactgcgccaagggcaagttgtctcgcgggaaacactccacgagtcgctgtggccgggatcctactggtcggcgaattcgagttcactcaaagtggcggtgcacaccctgcgaagagttctggccaactgccaagcaccgtccgaggagacgagctcgccgtcgctgcgcctggtcactcgccagaccggctacaccttgcaggccaggggggtctgggtggactccgaggtcttcgacgacctggtcgaccaaggacaccgtgccgagtcggccggggcccatcgcgaggcgagccaacactaccgggcggccgccgaactgtacgggggggacttcctggcaggatcccccatggaatgggccaatgtccacagggaatggctccgaagtcgattcctctatgttctccagcggttggccgaaaccagtcttgtggaagacgatccactctcggtgatgcgctattgccgtcggatccttgaaatcgagccataccgcgaggagagctatcgcatgctgatgtacacgcatgctcagctcgggcagctcaatcaggttcgccgctggtacgacatatgcacaacccgcctgcgcgaagacctacaagccgccccggaacccgcgaccaggctcacctattcccgtgccatgcacggccaactcaacgcgcacagctgggactccatcaactaccccacccacacggcagcccactgaaatcggccgaccaaagcctggccgccaccgaatcgccttacactctccgcatgatcagagaggcgtatctgcagggggccgcggccgccgccgatctcatgggccgtccgtccgtggccgccgcatggaacgagccaagcgtccttcccgggtaccgcgtcgccggcctgtgcggccatctcgcgcgcaacatcgtgctcgtcgagccgctgctcgccgcccctgccggcggcgcgcaccccatccctctcctcgatcactacaccggcgacgactggctggacgcggaccctcagagtggggagcatctcgcgatccgcgagcggggcaagaaggcggcggccgacggccccgagagtctggcagagcgcgtgtccggcgccgtgagccggctgaatcgggccatccccgcgcagcccgcggatcgggtcgtcgacctgcccggtatgtggagcctgacgctcgacgacttcctgctgacccgcctggtcgaggtggtggtccactgcgacgatgtggcggtgagcgtcggcgtgccgacccccgaactgccaaccgcgtactacgaggagacgatcgctctcctgtcgcggctcgcgatgcgccggcacgggccgattgccctggtccgggcgctcagccggagcgagcgggcgcccggcacgatctccgccttctgactgcggcggtggtcacctgggcggcccgcaccccacgccgctcagtcaccgcgccggttggtccatggccgcggcgagactgcgcggacgcatgtccacccactgctcctcgacgtactccacacacgacgcgtgccccgccggcccgtgcaccgtgctccagcccttcggcacgtcgaggtccgcgggccacagcgagtgctgcccctcctcgttgcacaggacgaggtaggtgccgtcggtgtcgtcgaacgggttgctcatcacagtcctccatgtgtcgtggtcatcccggccgcgtcgagcgaaccgggtcgtgtggcgccgcccaggcgggccgccgacaccggcccgatgcgggcgagcgcctggctgttcctcatctcgccgtcccgaggaattccacaaggccgtccaccgactcgctgtcgaaaagatcgatcagctcgaggttcagacccagttccgcgctgagccggcgtacgagctgcgcacccaggagtgaactgccgcccatggcgaagaagttggccgagcagtcgacctccggcagacccaggacctccgcccacacggccgcgatgcggccgtgcagttccgtgcgcggcgcgaccgaaggcgtggcatcgctcgacggcacgcggtgcggcacgttctccgggcgcctcgatggcttcgtccccgcggcgggcagcgacatcgccgcctcggcgagccgggcgagagtcgagtcgggagtcgcgacggcggcgtccagtatctcgacataagcccgggcgacgccgtccatggtagtggcgtcgaacaggtccgtggcatagcgcaggttcaggatgtgttgcccgtccgcctcctcccgcacctcggccaggaggtcgaactcggtggtgacctcgctgcggtgcagcaaccgctcgctcacctccgtcacgtccacgccgatcagacgcagaggctcgctttcgggcacgtactggaaggcgacttgatacagcgggtggcgactgctgtcgcgcgccgggttgatccggtcgacgacgtggtggaagggagcgtccccgtgctcgaacgcgctcgaaaggtccgtgcggaccgcgacgagcagttcggacagggtcaaccccgggtcgcagtccgcgaccaggaccacggaattgacgaagtagcccagcaggttctcgagctccggctcgccccgccccgccagcggcgtgccgaccacagcccgaggctcgtccgcccaccgtgccaacaggacgtcgaagacggccaggtggaccacgaacggggagaccgaggcggtgcgggccaacttcgtcacaccacggaccgcggcagcggggatcgggatctggcagaaggccgccgtgaagcggcgcagagcgggccttggccggtcggtgggcagttccggcgcgcgcacatcccgcagccgttgcgcccagtgctcgacggaggcctccagggcgggggacgcctcctcgcgctgccaccaggcgaagtccgcgtactgcgcggtgagttcgggcagttggggccgccttccctggacctccgcggcgtacagttcggacagttctcgccgcagcaggacgtccgagtcgccgtcccagacgatgtggtgcgtcaccagcaccaaggtgtgccgccttgctgcgagccggaacagcacgccgcgcagcaagggcggggacgacaggtcgaacggcttctccaacagtcctgccaggtcgccggcgatggcgttgtcctgctcctgtccgtcccggtcgcgcagatcgacgcgccgcagctcgaagggcgcgcagccacggatcacctgctcgggtcgtccgtccaccgggaccagtgcggatcgcagcaactcgtgccggtcgacgagcgcggtcaacgcccgctgcagggcttgtgggtcgagcgggccggtcagctcccagccggcgagcatcacgtacgccgacaggccgggaacgagttcctcggcgagccagagcgcttcctgaccgaacgacagcggtgcgttgtcttccatcgtcagctccttcgcgaaaggtcttccgccagggcgcgccggtccgtcttgccgttggtgttcagcggcagccggtccaggcagacgacgcgtccggggagcatgtgatccggcagtacggcggccaactccttgcgcagccggtccaggagcgcctcgttttgcctgtcgtccgcagcgtcccggaggtcggcggcctgctcggtgacgacgacgcacgcggccagggccggttcccctcgcgccgtgctctggacgaccgcggccgcgtcgccgatccagggcacggcccgcagggcgtggtcgatctcgcccaactcgatccggaagcctcggatcttgacctggtcgtcttggcgtccgacgtagtgcagttgcccggcctcgtccgtgtgggcgaggtctccggtgcgataccagcggcccggtctgtcgggcagctggaggaagcgctcggcggtcagttcgggcatgtcgacatagccgcgtgccacctggctgccgccgatgaggatctccccggtgcggccaggcgcgaccggcctcagttcctcgtccaggacgacggccgggctgtggtcgtaggccgtgccgatgggggtggccgatgcggcccgggtcacttcctcggccgtcaaccgcttgaacgtgttgtagaccgtggtctcggtgatgccgtagacgttgcaccatgcgggctgcggtccgggctgggatcgcgtccaggactggatggcccggtagttgagtgcctcgccgcagaaggtgacattgcgcagcggcaggttcaccgcctcctcctccacgacttcggcgaggtggtggaagacgctgggcacgatgtggagtcgtgtcacccggtggcgcagcagcagctcggccagggattcggggtcctgttgggcggcgcgtggaaccgcgaccaaggtggcgccgatggccaccgccgcccacatctcccacacgctgacgtcgaatccgtgggcgtgttgcaggggccacacctcgcggtcggcgaagtcgaacagcggcagggcgccggcgagcatcgcgaggacgttggcgtgggtcacctccacgcccttgggcacgccggtggagccggaggtatacatcacgtacgcgacggaccccgatccgggcacggtgtcgtcggcggcggcaccggcgaaaggcccggggatcaggtcgtcgccgtcgacgtgcagcatggtcagcgccgcgatgtcgggtgcggcacgaccggactcgtcgcagacgaccacgtgcagcccggcgttgtcgacgatgtggcgcagccgccgggacggatgcgcggcgtcgagggggacgtaggcgcagccggcgcgcatcagggccgcggacgccaccagggccaagggcccgcgggccacgctcaggccgacccggtcaccgggccggatccccaccgcacgcactctggcggccaaggcgtcgacacatcggtcgagctcggcataggtcaggcgcacagggcccgcggacaacgccgggcgttcgacgaactgtcgggcggagtggcgcaggacatcgctcagcgtgcgaagggacgatccgagcggtgcggtgttcacagggtcctccctgtcggggtgcggagcgacccaggcccgcgtacgccgtcgccgtacggcgtgtcctcgcgcatcggcagggggtgcgtcttgccctgtgtccaacgggcgatgtggtcgaggtctacggggccggtgccggcggggcttccagggatggtcagcagaccgtcctcgggacgggcaggtgcgacgaccaggcgcatggccgcgccgaagtcgggttgtgtgacccgcaggctctccgggcaaccggacagtccgacgccgcgttcacccgcgtggcctcccggcgggccgccgtggaccggcgcaccgcccaggggtgtcggcgcgagggcgttcacgctcccccaacgggtgggctcggcgctgccggtgcgcttggtcagcagtgtcttggcgctgccgagcatgcccaccaccaacgcggccggcccgggccaaggcttcggcaccatgtccgcggccaaggcgtcgaggagtcgacgcagaggccgttcgtggccgttgtagcagtaggtgaaggcctcgtcgtaccgccggcagggacgggtcagggcggcgaacagctcctcgcgcagcagttcccggaacaacacgagcagggcgagaccgtactcgtcgtggtgcgaggtgccgcgccaggccaggacctcgtcgcgcagagcgcgcagcggcacgggagcgcgctcgggcgtgtatcgaagcgccaggtcgcggtagtacgcgtacagctcggcgtccacatcgagttgcagcgcgccgcagcgagcctcgtcgtggggtccgcccgcggcgagcgccgcggcggcgcggcgggaccgggtgccggggaagaagttccagccgaggcccgcggttcgaccggccgcgtccccgttgttgcagctgatcacgtgtccgctcggtggtgtcaccagccgcggcagctcgtggggggcgaggcgtggcgtcggccacgggtcccgttccgagtcggagaagccgcgtggtccccccgcacgcctcggatggcggcccgtcacggtccaggcgacgtcggccgccgtgtccgcgagaacggcgttcaggggaggcatgccgcagtcgttcagcaggtcggccgccgcggcgacgttcgcgctctcgtacagtccgacgagggcgaagtcgagtgccgtggggtcggtgaggttcgcgctcaacaccagcggtcggccgcgcagttggtcgacgaccgggccccaccgggtctcgcgtacttccacctcgacgtcgtcaccgcccatgacgctgacgcgttcccgccggacggtgaaaggccggtcgcggccctcgtgccgatatgtgccgggggtgctgcccggggtcagctcccgcaactcgcaggtgtcggccgggagccgggtgaatccccaggcgattcgaccgttggtaccggcgacgatcgcgggcaggccgggtacggtcacgccggtgacaccggtgtccccgacgacgagccgggcggcgtacatcagcgacgggctggtcagctccaggtgcatgtcgttggcgaggacggcggtgtctccgtcggtgacggcccaggcgttgctgccgatcgggcggccgtccgagaccaccaacggtccggcagggccgggcggttcggccatgagagccttcaactcggcgaccggcagggcggatcggcacacatcgggcaccgtgccgtcgatgccgacggcgaactcgtcctgcgggtcgagcaggaagtccacgacggccgctggcagcgtccgtcgcatcacctcgaccatgcggacgtcctgtccgtccgacgagagcgcttggaacaccccctgtgtgaccgcgatgcagtccaccggtgtccacgcaccgcccgggccgttcggtgcggcggcgttgacgccgtccgcgtacgcccgcagagtgtgccgctgcgacatgggcagcaattcccagcaggcgcgggcgacgtgcgcgagccccaagacgcgctgccgcacgtcggcctgcacggcttgaggaccgagtacttcggcgagccgtccgtggctgcggcgtcgcatgaagtccatttgttcgcggcggtgtcgggcgaccgtccatccgaggccgaacgcggcggccgtccaactgggcgcggtcacgaccggccggtcgagtgcgtcggaggcgacttcgacgatgccgtccggggtgcgtagccgagcgggtgcggtggcattcatcgcggcaccgccgcaggggacggtgcgacggtcgcgtcaggcgcttcggcgaacagtcgcagggtgtccacgagggcgctcaggaccgcgtccggcctctgggggtctgcgggatcttccgtgtgttcgacggtgatcctcagtgttccggtgtcgtgggcgaacagggtgacgctcagccgcgggccgagcgcggagggcaccaggaggtctccgtggtcgtacagcggcgacatccgcagggcggattcggcgggggcccggtatggccggtcgaaggcgaccaccgcgtccaccaggtcgtcggggcacagccccactgcggcgcagggtggcccgagcaggtcgtccagtgggctgtcggcgcaccggcgagcctcggcgagctgggcctgcgtggcccgcacgatgtcgcgcggtgtcgcgccatcgggcaccggtacggcgagcagtgtgctgttcgcgaagggcccgacggtgcgctcgtgggcggcgtgcgctcggttgtcgagcagggtgccgatgccgacgtgccggcggcccaggagagcggcaagtgcggtggcgacggcggcggtcgccacgacgaagtcggtggcgccctcggtgccggcccatgcgtgcagcccgtgcagcacggaggtgtccagttcggcaccgcggcgcacataccgcatgccgcgcggagcgggttccgcggcggcggccaggtctgctgcgagatcacgagccacgcgcgtccagtggcggcgggagtcggccgccatgtcaccctgtcggcctccgcggtgcagggcgtagtcgatgtgggtgagggcgtcgctgttgtccatgtggacacggccttcggtgaccaactgcgtgtaggcctcggcgaggtcgtcgaggaggaccgtttgtgacacgccgtcgacggccaggtggtggagatgcagcacgagcaggtcggccgcatgacggcggcggaacagctgggcgcgcagcaggttgccccgcatgaggtcgaacggcttgaggtgcgcgaggcgtacgtccttgaggatggccgcgtcctcggcctgcccttcgatgctcacgggcatgtcccgctccaccagttcgacgtcggcgggcgcccaaggtggaacgatcacctgctggtgtgcgccgcctccgtcgggcgtggggaaggccaggcgcagcgcgccgtgccgagtgagcaacgcgtgcagcgcgagccgcagggcagcgccgtcgacgggcgaatccagggcgacgggcacgacgatgctgtggaccggtgagggcccgagggcatcctcgatgcgcagcagccgctcctgctggggcgacaccggacctgtgacgcggcccgaggtgcgcggccgttcgtcggcgggggccgagtcctcgccgagcgcggcgatcgttcgagtgacgaagtcggcgaagaccggatgatcgaagatgagtccggcgggcagatcggcgtcaagtgccttgcgcatgcgggacatcagacgggtggcgagcatcgagtggccaccgagcgcgaagaagtgtgcgtcgtcgtcgacgtcggggacgtgcaggaggtcctgccagaatcggcgggcgaagtcggccaccgtacgggcgtcgcgtcgcccgtgcggcacggggcctgtgtccatcagcgtctctccctcctcgtttcccacgggttcagcgctctttgtgtgccagtgcggtgcgcagcgcggcccgcaccagcgcgatgaccgtcggctggtcctcctcgatgaacagatgaccgccgtccaggtcgagtcggcgcaggggctgctgcgtttcgcgggcccagccggccatcacctcgggtccggcctcggggtcgtcgcgccccgccaaggcgacgatgggcgtggacaggacggggccgggcgtgtggcgatagcggtcggccagcgcgaagtcggatcgcagcatcggaagcagcagggaaagcatctcctcgttgtcgaggatggcctggggagtcgcccccatctctcgcagcagagcgatgaactcctcgtccggcagggtgtgtttgggggacagcgccccgcactcacgcggcggtgcgcaggccgcgacgatgaggaggagcggagggcggcctcgtcgggccaggccccgcgcgacctcgaaggccaggagtgcgcccaggctgtacccgaacagtgccagcggcaggtccttctgcagcggggcggtggcctcggccacgtcgtcggcgatccggtgcaggtcgtgctcgagcggctcgccccaccgatgggccctgcccggcaggcacagcgggagcacgtccgcggtgcccgcgagtgccttgtcccaggtgcggtacatgacgggtgagccccccgcgtagggcaggcacagcaggcgtacggcgcagtcgccgggggcgggaggggcggggaaccacaggcccgtcgcggtggccgagccgtggtgggtgtcgtcacgcgtaggcacgggactgcctctcgtagaggtctcggtagatgccgtcgtgctcggccatcaggtggtcttggacgccgagttgcgcgatgcgccttccggtcgacgacgacgatcaggtcggcgaggcgtgcggtggacaaccggtgcgaggagaacagtgtgatgccgttggactgcgcgacaatctgccgggcggcccggacgtaggcggtcagcagcacgtcctcggccaagggagcgatcgccgcggtgggttcgtccaggacgagcaggcacggcgcggtacgcattctggcccgggccggtgcgacgcgctgcgacgctcgcggccgtggggcggtcgtgcgtcggctgtatccgggcatccgtctcgacgcgtgcacggaccggttcccctgtacgaccggccacagcgcctcccattggtcgtcgtcgagcaggaacgcctcgcgagcgaagtcctgacaggaccgtacgggtgcgcggttaggccctagttacgtggttcgcgtgccccgtgcgccgcggtcactgccccttgaggcccgccacgacaggcgcgaacggcccggccgccgcggcgggcaccgtgacacagtcgaatccccagcgctcacgtcgggcccgaagaatgtcgcgggacctgggccgcgatgcccaccaggaagcaggcctggcgggcatcagtgggtgacgcggatcgttgttgagtacgtacgtcccgacgacaaggtcgtccgccacctccgcggcggccgccaccgtaggcacgggtgccagccgctggtccacgtggtcgctgacgagcagtgcgtcgtaccccaagtccactgcctggcgggcgagttcacgccgctcccccgtcggtcgcatcaccgtcgctgaccagtgcgaactgaaaaccccgaggttgcgacagctgtcccctcgttcgtccgtgacagtcgatcgacgccctccacgggcggcagcgaaccgatgatgcccgtgcacggacctcgccgcgatacccctcctcaagaggatctctcgttgctacggtgacgtcgctcaccgcgcatcacgaggacttccccgtcgttcccgcggaaaggacggaaccgccgttgaagcaaggtgtcgatccacaacgggccaggctggtcgaggcgttgcgcgcccggcgacgaacgcagaccccccagacgctcccgatgaccgcgacccagcagggaatctggctcgccgagcagttgagcccgggcgtctcggggtaccacgacacggcggtcctgcgcatcgacggccccttggacgcggaggctctgcgcttggcgttgggcgacgcccgtgcggtccacgaggcgatgcggtgccgtgtcatcgaggccgatggagagccccgacaatccttcgacgcccccacaccggagttggctcacacggacctgggcgccgtcgatgcgcagacccgggcggctcggatcgaacgattgacagcgctgaccgctaccgaacctttcgacctggaggcgggcccactctggcgtgcccgactgatccgggtcgaatccgacgagcacgtgctgatcctcgtcttccatcacctgatcagtgatggctggtcccatggtgtgttgctgcgcacactgttgtcgcactacgcggcacgagcgcagaacacagccctgccccccactcccgatacatccgcctaccgcagatggctgctctcccgggtcacgcaggaacaggccgcggtggacagcggcagggcccgcgaggtggccacgcttctcgccgaggccccgtaccgggcagcactgccggggctcaaggggccaccgagcgatcggctggcggccgctgtggaactccccgtgtccgacgtgacatgggcctccttcgaccgggcatgcaggagagcgggggccactcgacacatggggctgacgggcctgttcggccacctcctttcccggaccctgagatccgagcgcacggtccttgcctcaccggtcgcgatccgggacgacccggacagcgcgcatctgatgggttgtctgatcaatgtggtgcccatggtgctcgtgccccgccccacggccgaccccgcggcggcactggccgcaggacgcgaggccgtcctgacggccctccggtacgcggacgtgccctatcgtgacgtggcccgggtcctggggccactgaccgcgtcggacgacccggtcaccaatgtcggtgtagaggagttcaacgctccgcaggagccggtgcgcgtgggcgatgtagtggtcaagccgatgccacgcggccatgtccggctgcggcacgacctcacactgagcgtcgcacgcagtggggcgagcgcccaactcctgcaccccgtccaaaactggaacgtgaacgaaatacagtccctcgcacagaacctggccgagctaatcagtgacactgcggcgtctgtcaccccggaaaaatgacatgtacgaggagaagcactacgccacccaggcagcggccgaacgaacgaacctgaacacccatcaaccttagctgaccagctgatcagtacctccccgagcatcgggggacctcagcactcggggaccaggtcaccggccgggtcgcgcaggccacgatcgccgtcctggtcctgggccggcggctgggggtgcccgtcgcggaggtgccggtcccggaggccgatccgcaccaggcgcgggaggtcttcctgaccggtaccgcatcggaactggtaccggcacgggagatcgacggtcaccgcttcgagccgtgcgggccggtgttcggccgactggcacgggccttccacgacaccgtccgtggccgcgcgttcggcgacctgggctggtcgaccggcgtctccgagcaatgagcgggtcgggcggcacgcgtaaccacggcctaacctctgatcgctagtttgggccccgcttcgagcacagcgtcgtcgccgacctcgcggcgcacatcgaccggttcgccgcgcggctgagtgcccgggcgtgaccgccacatacaccgtcacccgcggctggggcgtcgacgggccaccgtggtcaggagggatcgagcgtgcggaacaactgcttctggggtccggtggtcggcgacgagcagatcgccgctctcgttcggcactacgccggccgtccggccgcgctcggcggatcgtctgccgcgaccgcactctcgccccagcagagcgacctgtggcgggcggcgcgcccgctcgtctccacgccggtgttcctggcgaccgtggtgttccggctgcgtggtccggtgcaccgcacggcgctggccgcggcggtccggcgactgtcgctgcgacacgacctcctgcgtaccgtgttcgagaacggcccggccccggccgcacacctcggcgagccgcctgagctgcgggtggtggaggcgcctgacgcggccgcggacacggcggaggaactcgttcgcggcatcgcccgtaccccgttccggttcggcgaggagccgttgttccgggtcacgctcgtctgccgcgccgaggacgactacctgctggtcctgacctgccaccaactggtgatcgacggctacggacagagcctcttgctgcaggagttcacgagtctgtaccgcgccgaaatacgcggggagccggatgacctgccggagatcaagcagccgtaccgggagacggctcgcctcctccggaacccggacccggaggtacgccgcggtgacgaggagttctggacgtcacggctccgcgatctgcccgtcatgagcctgcccggcgatcggccggggcccgagggggcgacgctggcgcccaccggggccgtcgagacggtgctgcccgacccggacggcgccgtcgtcgccgggttgcgccggcttcgggtgaacctgttcgcgctgttcgccgcggggacgatggcgatgctgcatggctataccgggcagaccgatctctgggtcgcgaccgtggtggacaaccggttgacacccgagtcacaggcacacgtcggcccactggccggaccgagggtcgtacgggtcgggttcgccgccgacgcgacgttcggtgtgttggcgcgggcggtgcagcgcgaggtctgggccaccatggaacgccagcacataccgttccacgacgtgatcaccgcggcgaccggagacggcgccgacatgcggaatctcgggtcggtcggcatcaccgtgaccccgtcgatccagctgcccgactggccgctcggcgacatggaacccctggagttcgacccgctggagggcgagccgagcactggttcgccgctggcgctgctcgtggaggagcaggcgggaaggtaccgcctgcgtctggagttcgatgagagccggttcagtcacgggcgggcgcacgacatgatgacgacgatcgccgatgccgtggtcgccgccaccgcggatccgcagcgttcgctcgcttcctggcggggtccgacatcagccgacgactgaccgcccagtccctgcctcgtgaccttgggagcgtctcatgatcgccgatcacccggctcggcacccgagtccagtcgaacagtggaacgagacgcggtacgactactccgcgaccagtcgcatcatggatctcatcgattcggccgcggtcaagtacgccgacgatccggccgttcgaacgacatccggagtcgcgctcacgcatggcgaactcgcggccgagagctcactgctcgccgagcgtctcgcggcgcacggcgtccttccgcgcacgccggtcggcctgctggtcgatcacgtcccggaggccgtcgtggcgatccatgcgattctgcgcgcggacgcctactacgtcccgctggatccacgatggccggcgcgccgcatggcggaggtactgaaggcgagcgacatcggccatgtcctcgtcacggaaccgtaccgcggcagggcgagcgacatcggcgacgacatgacgatcatcgcggtacgccacggcagtgaacccgaggtgctcgcgagatccgcctctcggccgtcggtccggcgacacgaggccgggcccgcggaaccggacgagttggcctacacgatattcacgtcgggctccaccgggcggccgaaggcggtggcggtccggcacaccagcgtcgtcaacctgatccagtggttcaatcggcgcaactccgtcgacccgagcgacatcctgctgcaggtagcggcgttcagcttcgatctgtcggtgtacgacgtcttcggggtcctggctgccggtgcgagtgttctcctgcttcccgatgccgagctggaagagctcgaggagatcgcgatcgccctcgtcgagcacccggtgacgctgtggaactccgcgccggccatgttcaccgccgtgacgctgctgctcgacgaatcgtcccgccagcaccgggatcgacttcgtcgggtcttcctcagcggtgactggatcccgctgaacaccctcgaggttctccgccgtgagttcccgcgcgcgactctggtggcgctcggcggtgccaccgaggcctgcgtctggtcgaacgacttcgttgtggacgaggtggacccgtcgtggcggagcatcccgtacgggcatccgatgcagaacagccggtactacgtccttcacgacgatctcacgccctgcgacatcgacgaaccgggcgagctgtacatcgccggtgtctgcgtagccgcgggatacctcggcgatccggccctgacggcggaccgatttctgccggatccgtgggaccagggcgatggtttcacgatgtaccggaccggcgatcgtgctcgctggacgtcgaacggatgggtcgaattcctcggccgcatggactcgcaggtgaagatccacgggttccggatcgagctcggcgagatcgagcaggtagccatgcgggtcctcgacgtcgacgaggcggtcgccctgaagctggacgacggagactcgccgtacctggccctcgcgctcagggcttcgggagagctggacgccaagacggtcaaggaaaagctgggtgaatggctgcccaggtacatggaaccccgtcgcgtggtcgtatgccggacctttccggtgggccagacgggaaaggtcgatcgcgcggcgctgcggaagctctttcagcccgccgggtagcgaccgtctcggagttatcgatgggagtctcgatgtacgacgatctctatgacgtcattgtgatcggtgcgggagcggctggcctgaccgcggccaccatgctcggccgttccatgcgaagcacgctcgtcatctcacagccccggcgacgcaattcgccggcgagctcggtcaacaacgtcccgtacgccgacggggcggccccggcggacatctatcggaagatggaacaggacgccggtcggtacggcgtgaccctgctgtgggacgaggtcacatccgttcgcgcgtacgaggaccacgtcgtcgtcgagggcggcgcgaatcccggtctgcgctgcagaaggctgctcctcgccaccggccgcgtcgacgtcctgccggcctggctgccggacggtgtctggggcagatcggccttcgactgcccctactgccacacgtacgaacgtagtggcagcacgttcgtctgcgtgggcaccggggacgagacgctcaagttggcggccttgtcgaggcagttcgccaagcggatgacggttctcgtcggggacccgtcggcgagccggggaagactcgccggtctgctctcccgccatgacgtcgaagtgctgtgcgatgaggtggtccgtgcctccgcggacccggcgggcggcgtcatcctggagacggcccacgggcggaccctcagcgccgacaccctgctgctcggcgatgtggcccggccctatcggaaattcgccgaggacctcgacctcgagctgtcggcggacggcttccccgagacgagcctgtacgggatgacgtcgaatccgcttgtctacagcgccgggaacgtcgaaggatccccgtacttcatgtggaccggagcggcgagcagcgggatcaacgccgcccgcgcgatctgcgaggatctcgccttcgccagtgaactgctggacgactgggagtgaagctcacgcggccggcgcgaccgctaccggccgcgaggcgtagtggacgagcccttccgccacggctacgaacctgacgaagtgctcgtggtgcgtgaacgcctcggcgctcagcgtggcgtcgacgcgcatccgtgcaggagatcccggccggatggcgatccgctgcgcgtccgggaacgtcatgccgaagttcgcagcccccgacgtatggatggcgccggccgcggtgatctcctgcgagacgctcgcggcgggtgtcatcagcacgtcgacggtgacggtgcccggccgcttccagatactcgggcattcgatgacaacctcgccgatgaccggctcgagcggggagtcggctgtcggcccgcacacgttgcagatcagcgcgcgacgcccgacctgctcgtacaccgggtgccgcgcgacaagttccgccagccggcccttgcagtacgggcaggcatcgtcgatcgggcgcacactcgtgtcgagaatgccctcccacatctcgttgagggcggagtggctcatcttgccgaactcatggaagtcggcgaccgcgctcagttcggcgtcggcgatcaggctgcccagccggcgcagcgggccgacggccttctcggcgagatccgcgccgagggccgtcctcttcagcgtccgggccagttccaggatctcggcttccatggcgacgattccgtccggcggcatgaatccggtcggcccgaactcgctgagcgcccgcacggtccggccgagtcgcagcagttgcggcttcacgtcgcggacgccctcgtgcgcgtcgacgctgggcccggcgtcggtggtgggcgggggctcggatccaccgcccgcggtcacccagggcagtccgaggaccgcgaagtagggcagctcacgaccgctgtcccggaggtggtcattgaccgcggcgcaggtccgcccggcgtccgtgcccgccgccaccgcggtgccgaccaggtcgttgatcgtgaggttcggcagcatctgatgaacggcaccgatgtaggccgctggaatcccgtactggaacgcgcccgccagttggtactcggccgccaccagaccggtgccggggcgccaggccatgcacgagttcgcgaacacgatgtcagcctggacgcgggccgccttgatgacgtcccgcgcccggacgccgtcccggaagcagcggtccgagaaggcacagctcggtgcggccgcgccctgggcagacggcgcccgatgtccggcatggtcgccgcagatcacggtgtcgctgaggatcagtgcgtgttctcgcccggccgacgcgaaggacacgagtccggtgtactgctcggacagcatcggctcgagcaccgcgcggctcgcccggtcgccgatgacccattccggcgcggcgtccgcgccatccgaggccgggattccgctcgccgccgcctgctgacgcagccaagggaccacggtcagccggctccgctccggaggtttccggaggtgacagctgagtcccttggcgagcagccagctcagctcgggaaggtccggcccgatcacgaatccgatcgtggcgtgccggccatcatgccggtatgcgctgacgacctccagcgactcggtgaccatgtcgagatcgatttcgtcgtgcagagcgacgaagaccacctgcgtggcttcgaggcgtgcgtcgaggatccggcccagtccgccggtggacagcgtcacgaacgagccaccgaagcgatctgccagcgcccgtcccacggccgtggccgccgagccggccggcgccaccaccagcgcgcccgagacgtccgggtccttgcgccgggcaggtgctcccatcaggctcgcgagggcggcaagccggctgtcgtcgacgcccagcatcggcacgagcgccggatcgcgcaggtcacgcgtgtacgaatcggctgccgtgtggacgacgaacgggcccgtctgctccatcgctactccattccgcctcggttcggatcgatggtgaagccacccggacgccccgcttcggccgcgattctgcggacttctcgatgatcggcggcgacctgtgcggggtcgctgtgcgccaggaccgccatgcccagccgttgcgcgtcgaagaggtcggacgtctccgggacatagtctccgtcttgaacgttgacctggaggtggtagcagctgggcaggtccacgatggcgtccaggcgggagaggccgctgacgactccggcggatcgcacggcgaagaagatcgcgagggtggtcagttggagcgggtagccgtccgggatgttccggtccccggccaagtaccgcaccatgcggtcgacgctgttgtcaccggtcgccagctcgcaggtccacgggtgcccgccgcccgagagccgggcgttgacctcgatgagcagcggcccgtcctcggtgaccatcacctcggtgtgcgccgcgccgaacgtgatcccgagcgcgtcgagggcccctttgacgtagccgatgatcgcgtcgttgcccggtgcgtccatcggcaggatctccatgctcgcgtacagggcgatgtgtcgccgactggagaccttgtggtaccgcacgatgtcgttcaccgtgtgcctgccctcgtagctgaaggtgtccacggcgtattcgacgcccttgacgtgctcctgtacgagcacctcggaaatgggcgaaccgtatcggttcgccgagccgagcaaccctgtgacgacggcacgcaggtcatgtccgccgggaacgaaccggacgctgtccgtgccggccgagtcgacaggtttgaccaccagatcacggccggacaatcgctcacgggtgatccaggtgagcgcgtcgccgacgtcggacgtacacagagacctgatcgtcggcaagtcggcagccgcgacggcggcgatcatgtcgcccttgtggtgccgcgccgatccgaggtctggcgcgttcgccagcttcggtgtcagcaccgcggcgagctcgtcggccagtttgacgccggtatgggtccccggcacgatcgcgaccggatcgagagcccgcaaccggccgacgggcggcccgagttcaccgccgtcgtaggcgatgtgttcgtcgaagtcggacaggcgaagcgtcgcggagttcggtgccgagagcccggacaacgtcacggcgcacggcgagaagccgccctgccggaaggccggcgcgagcatgtttcccgacgagtacggctcgacgatgaccacggttcctcgacgcatgtcctgtccgctcctcggaagcacggcccggttacctcttctcgtcgatccgggccgacaggagcgcgatcgtgcgacattccgtgatgtccttgaacatgacccgcttgccgagcgccgcacgaacctgggagatcacgcgagtggcgagcagcgaatgcccgccgaggtcgaagaagtcgtcctcgagaccgacctgctgatcccggaacagctgctgccagatccccagcagtaccgctgtggtgtcgacggtggacgtcggctcgtcgtcgctcatccggccactcctctctcctgcgtcgcacgtgcccgattccggccatggtgcgcggtgagctccgcattgacgacggacatgatcgtttccaatggctccgggccgaagacctcgtagtggttgccgttcacggaccaggtcttcaggctgccgtcgacgaacttctgccacgagcgcggatccattccctgtgcgacgctgtccgccgccgtgaacatgagaacgtccccgccgaagcggccggatcggtgctgcagcagggcgccgcggttgttcgcgaagacctgagcaagcgccggaaggtactcgtcggggacggccgccgccgtgccgggcgacgcctggagcacccggcgcagctcctccgttgtcagctgcgggtcggccgccgcggactcgacgttcagcgtcgggtcggtctgctcgccgtcccaggggtagctgtcgaggagcgccagcatggagacctcttctccagcggcttcgagtatcacggccatggcgtgtgcgacgttgccgccgaatgaccagcccaggagctggtacgggccgttcggctggatgcggcgcagctcgccgacgaagtccgtcgcgatgtccgtcagcgtccggccgacaggtccggccccgcggattccacgtgattgcaggccgtacatcggaaatccgtccgccagccagcggctcatcggtgtgtaacaccaactcagcccgagggcggggggcatgacgaacaccggcgtccggtcgccctcgggacggatgcgcagcaccacgtccaggccgtcggcggccggacccggcgtgccggatcccgcctcggcctggtccagccaccgatcgatccccgccggtgtcggctgttcgaacatcacgcgtaccggcagttccgtgccgagcgtcgagcgaatgcggctcaccaggcgcaccgccatcagggagtgtccgccgagcccgaagaagttgtcgtcgaccccgaccttctctgccccgaggatctgggcgaacgcgccgcagagggcgtccagccgcggtgtgcggggacgtgtggcggtgtccgcggtcaccgggaccgtcgtgtcgacagcggtccttctcgccggccgggcgtcgaccggaagcggtacggcgaacgcactgagcggcgtagccggattcgcggtcactgcgtcgatgatgtgtgtggcgtaatcggcgatgcgctcgaccgtcgagcggtcgaagaggtcgggactgtacccgagccagcccgcgataccggcaccggcgccttcgtgcgcctcgggcagggcgaagttgaaggacaggtcgaatgtcgggaggccgaggaggtccacctcctgtcgctcggcgacgcaaccgaaaaggtcgcgaccggcgccgatcccttcgtcgaggacgaccatgacctggaacagcgggttcctcgacgcgagccggaccgggttcagcaggtcgacgatccggtcgaacggcatgtcctggttggcgtacgccccgatttcggcctggcggacgcgggcgagcaccgtctcgaaggtcgggtctccgtcccaggtgcaccgcagcacctgggtgttgacgaagaagccgatgccgtcctcgagccctggaccggtccgacccgacaccaggccgccgatcgggatgtcgccgccgcccccgagtttggcgagcaggaccgcgacggccgcgcgcagggtcgtcagcagggtggcccgtgcggccgccgcctgtgcgagaagccggcgatgcgcatccggcgagacggtgaaccgcacgccgtccgcacgtgcggtcaaccgcgccggacgctgccggtccaccgggagcggcagctcttccgggagaccggcgagggtctgtgcccagtaccgcgcctggcgggcgatgatgctctgactgtcggactcgcggcccagcaggtcccgcttccagatgctgtagtccgcgtactgcacggcaagcggctgcggctgccattgcagtccgtcgcgcctcgcgaggtacgcggcggacaggtcacgccagagcggggccgtcgaccagccgtcgccggcgatgtggtgcagggagatcagcaggacgtgttcctccgggctgatcgccagaagccaggcacgcaacggaggctcggtggtgaggtcgaacggcagcgcggcgcgccgcgacagctcctcggagatctggccgccggcgacgtccaccacgcgaagccccggccgggcggcggccgggtcgagcacgacctggtggggctcgccttgatcgcggggaaacaccgtacgcaggatctcgtgcctgtcgatcagccgatcgaacgcccaggcgagcgcgtcccgatccagcggtccggtcagcttcagcgacagcaggatgttgtgatccgcgctgggtccacgcagctgttcgtagaaccagaacgtcgactgcccaggggacagcgggatcctcgccgggcggccggccggccgggggcgcgggctcgccgcggccgcctggtcgagcaccctcgccagacccctgggggtgggcttctcgaagacgtcgccgaacgtgatatcccccgggaagaccgttcggatctggccgaccagtcgggtggccagcgcggaagtgccgcccatgtcgaagaagtccgcatcggcgtcgacgctgtccagcccgaacaggctcgcgaacatctcacacagcaccggttcgctggaggatcgcagcgactggaccggagtatccggtacggacatcgaccactctctgggcttcatgagtcccctcacagctacgacggccacacaggtgcgaacaccgacaccggtcggcgacagacagtgcgctccggcttgccgggcgactcaccagacatccgtgaccgtcaccggcaggtgcgtgatgcccggcatgaagttcgagcgcggccgtcgcaccggaccgggtatttcgcagcggagccctcgccgcacgatctcctcggtcagcagcgcgatctccctgcgcgccgcccccatgccgacgcaacggtgatgcgcgacgccgaacgccaggtgctggtcgggagtgcgccccaggtccagtcgatcgggttcggcaaaggcgtccggatcgcggttggctggtgcattccacagggtcacggtgtcgccggcccggatcgtctcgacatccgcgtagcgggtcaacgccccatgacctgtgccgtccgggccggcgttccagtgaagcggagcctcacggcgcaaccgcgcccaggcggcgtgcgggtcgccggagacgaacaggtcgagatcatcaagatcgatggccgtggccgacatgttcttcatctcccacgaggtcgccggacggacacgtgtcgggcgcccgataccgacgcagactagggcggccgagttagccgtcggttatgcggcgaggccgcgcgtgccggtacttcggccggccgccgctcccccggcgtggggcggcggaatccgcggcgcactgcgtacgcgtacggcggtcagggaccgggcgcgttcctgcgtggcaggcgaactgccgtctacaggtgcgtagctctggacttgccggtaccaagtcgccgtgggtgcgccaagacgggccgtcgctggattcggtgggcaagctcgccctgtatccgccggtctcccccccacagcgggttctcgcgtgcgaggcgcaggatcaactcccgcgtttcttcggatatcgcgggtcggcccggcttctcgcgggggtaggtccaccggtcggcgaccagctcgcgatgccaacgcaacaacgtcgccggagtgccgaagaacctgctccaacgctgtcggggttccaacgagctccgtgccaggaaatagatccacgaccaccgcatggactccaaccatcgtcgcccagcctcgctcccgtagggaaacaacccaggtcaaccggccgagccggacgagtcgtctgtgggccggtcgaggggccgtcgcgcacataaccgtccggaaaccacgagtggatagcgtcgccccgccgcacgtggaatgcgacggggaatgtgccgagggagagcttacgtgccactcagcgaggtgagcggcgggcagaaatccgccggggagtccgccggggccgaggaaggcggcatgcgccgacgcacgccgccgatcgccgtgctcaccggtgagatgctgaccatggaccgcctcggcaccctgggcctgtcgggtctggtcgccctcgcggcggtgctgcccgcctccctcgccgtcacctctggcgcacttgcggggaggctcgccacctcccacgggaaggacctgttcgacggcgggggcggcgcggccgcgctcgcactcggcgccgtgttcctgctgatgcaggtggtgcctccgcttgcccaggcggtcgccgagtccctcggcaggcgactgcaccgagggctggccgagcgtgtgctgaccgcgctggaacgccccgccgacctaggccgcctggaagaggcgcgaaccagggaaatcgtctccgccgcggaccgcggactgaacggcacctgtgtccgggacgccgtggtgggagctgtcaacgtcggcatcgcgcgcggcggcgcggcgtccggtgtgctcctcctgctcgcttaccgctggtggctcgccgtgctgctggcagtggcctacggctacgccatggtcatcgtgtcgcgcatgtaccagcgggccctggagtccgccgaaggcacccccgccctcatgcgccgcgcaatgtacctgaagaacaccctgtgcggcgcctcggcgggcaaggaggtgcggaccttcggactgaccgactggctgctcgaccgctacaccacggagtggcgcaaggccatcgccaggacccgtggtgaccgcgcgggtgccgcacgggtcagcctggtgagcggcgtggtggtcctggccgcgcagggactcgcgttcgtgctgctggtggcggacgcggtcgacgggcgggtgggcgtcggcaggttcgtcatgttcgccgtggcaggcgtcgggctgctggggctcggcatcgtcacccccgatctgctgaacatcgaagtcggcggcacggtactcgcggccgtgcggcaactggaggcgcacacggcaccaccggacgcggccccgccgacgccccgtggaccgggcaccggcggcggtgacgccctggtcaccccgtccctcaccgctccgccgtccaccgccatgccgcagcggtccatcgtcttcgaagacgtcggattccgttaccccgggtccggcacctgggtacttcgccacctcgacctcaccgttccggcgggcacgtccctcgccgtcgttggtgtcaacggcgcggggaagaccaccctggccaaactgctgtgcggtctgtacacgccgaccgagggccgtgtcctcgtcgacggcaccgacgtgcgggaccttccgcccggcacatggtggaactgctgcgccgccctcttccaggactgggtcaggtggcggctgccgctgcgggacaatgtcgcccttggcgccccgcaccgccctgcgaccggaccggagctggcggcggtcgcccgcgccgccggactcgacgaggtgttacgggacctgcccgacggctggtccacggtcctcagccgcgagtacggcggcgtggacctctccggcgggcagtggcagcgtgtcggactcgcccgtgcactgtgggcactgtccgcgggcggcacgaccctggtgctcgacgagcccagctccgctctcgacgtgcgcggcgagacggagctgtacgacctgctgctggccgcggccgagggcaggaccatcgtgctcgtctcccaccggttctccaccgttcggcacgccgacacgatcgtcgtcctcgccgacggagcggtggccgagagcggaagccaccaggagctcatggacaagggcggtcggtacgcacacatgttcacggtgcaggcggaccgttacgtcgagcggggtgaggactgatgacgcgtcccggccgaccgcgctgcggcccgctgcgtgccgcgctggcgctctcccttgaagccgatcgccgcgccaccctgatcaccttcgtcagcttcggcctacggcccaccgtccccgtggtcatcctctacctggtgagagtcgtcgtcgacgccatcgtctcgcacgaccaaaccgccctgtggaccgctgtcggtgccgccactctcgccaccggtctgtccatgggcagtatcacctacgccatcgaactcaacgtccgcatgatcgaggccaccgccgcggtggtcgaccggcggctgatgcgaacgatcggtggtctgccgggggtggcccacctggacaatccggaggtgctcgaccgcgtcgagatgctgcggcaggaacgcgtccatctctccgagggcggtgacgtgttcgccctcgtcgtcggcgccgtggtgcgcgcactggtcaccggcctggtgctcgccatggtgcagcccctcctgctgttcctgccgctgctggccctgccttccctgctcgcctcccgccgcggccagcgcaagcggtccgacgccgtcgcccggtcggcgacgacctcccggctggccggccacctgtacaccacgggaacctccttgcccgcgggcaaggagatccggctcttcggtctgggacccgcgctgcgcgagcgctatcgcaccgccgccgcggacgccgacgccaccgtcacccgcgctgtgtggggcggcctggccctgaactgcgcgggcggggcgctgttcgctgttggctattgcggcgccctgttcttcgtactgcacgacttcgcccgcggcacgacctcgctcggggatgtcgtcctcgtcctcgggctcgtcacgtccatcagcacccagctcggccaagccgtcgtcttcgccggcttcctccaccaggtcctctccgcgtcccggcggctgctgtggctggagcggtatgcggccgacgtggctcggccggcccctaccgcacccgcccccggcccccggctgtccacggggatccgcttcgaaggcgtccacttccagtacccggacaccggcacctccgtcctgagggacatcgacctggagctccccgccgggaccgtggtcgctgtcgtcggggccaacggcgcgggcaagtccacgttgatcaaactgctcaccggactctacgaacccacgcggggccgcatcaccgtcgacggcgtggatctcagggaggcgcccctcgaggcctggtacgcgcgcaccagtggctgcttccaggacttcagccgactggagttcaccgtccagcacagcgtgggcgccggatcggttccgcacgccgacgaagccgcgcgggtgtgggaagcggtgaagcgtgcagccgccgcggacctcgtcgagcgcctcccgaacggccttgccaccgaactcggcgcctccttcgacgccggtaccgagctgtccggcgggcagtggcagcgcatcgctctcgcccgcgcctgcatgcggcgcgccccgtgcctcctggtgctcgacgaaccgaccgctgccatcgaccccttggccgaggacgccctgctgagcgcctacgtcgacgccgctcggcagagtgcggcagcagcgggcggcatcacgctgttcgcctcacaccgcctctccacagcgcgtggcgccgatctcatcgtcgtcgtcgacagcgggcgcatcgtccaactgggccggcacggcgacctgatggcacagcgcgacagcatctaccgcgacctctacgagagacaggctcgcgcgtacgcgtgacgtcggccgcatgccgggacgcggaccaggacgtgtccgcggggccatgccggtgcctcatgtccggcccgggggctcaccggcccacccctcggcacggctcggcgcacggcccataactggaggctaactggggggcgttaccgttcccggcaccgtcttcgttccgccccgctaccggatcgatcaccctgggagagctcatggccgacggcgtcgccacaacggtgggagcagtgttctgcgacctcctgaacgtgcccgcctgcgcagagcacgagtccttcttccaactcggtggagactcggcgctcgccaccagggccctggcactgctcggcaaggagtacggcgtccgtatccccttcgccgaactgtaccgggacgcctcaccggcggcggtcgcccgggtgatacacgaactgcgcgcagcgcccgtcgcaccgcggcgctccctcgccgatgtggcccggcgccggcgccgcacctggttcccgctggcactcagccaacgcgcgctgcacaagatgaatgccgccaccgggggcgcggggctcttcaacaacgtgggcgtcctgcggttcaccggcgatatcgacgtcctggcgctgcggggcgctctggaggacaccgtctcgcggcagtccgcactgcggctggtgttcggtgttcacgacggccggccggcccagcgcttcgccgacatcggtcccgacgtcaccgaggccgatctgcgcgacggcggtgagccggcgttgcgggcacgggtgcgccgcgagcggctccgcggcttcgatctgaccggtgccggtccggccgcgcgtttcgttctcgcccggaccggcgagcgcgcgtgggtactcgtgtccgtcttccaccacatcgtgttcgacggcatgtcccaggggctgttcgtcgacgacctcgcccacgcgtacgcctgccgcctgggcgaggccagtgcgcggcccccgctggccatggactacgccgacttcaccgaatggcagcacgccaccttgtgcagtgaccgtcttgaagctcacctggacgccatgcgcgcctcgctgcgtcgctcgcccacgccctcgctctccccggcgggggcttcgggacgggctcgcagcttcatcagcagggcacggccgttcaccgttgacgcgcacctcacccgcgccctgcgcgcgctggcggcacgctgcgacaccactctgttcgtcgtcctgctgagcgctgttctcgacttcacggcacggcgtaccggcgacggcactccggccgcggccatccagacctcgaaccggggcctggccggaacggagggcaccgtgggctgtttcgccaactccgtccacgtcaccgtcgaccgccccggagggacaacggccgcgcacctcgtcaggctgacgaaggaggcgatggccgaggctcttactcaccaggagatgccgacggaggtaagcctgagcatcctggcagaacgtggcaaactgcccagcggaccgaacactctgccgcaggtcgccttcgccctgcagcccccgcgcgacgagcgccgcgacctgccgggagggcggctcgacgctgcttatgtcacccaggagggcgacgcggtggacccgacttcgctggccctggtgctcgaactgttcaccgagaacggacaactcaacggggtgacacaccaccggctcgccgactggtcgggcacggcgttcgccgcggcggaacaagacctgctggctgccttcgcccgctgcggcggggccggttcggacctcgaacacctatcgcgacagaaaggctgacctggtgcccacgtcattttcccgcatcctcaacgaggacgatctcaccgaagtacgcaaccagtacctggaggcactggaggcgctggaggcggaggagaacgccgagcagaggggcgaagagcgcgacgagcagcccgccagaacccacgaggcgggggccgcatccgtcactgcccccaccgagcaagccgcagccgcagaagcagacgcggaagaggagtgatcagtggacttcgtgaccatcgacgacccgtccgtcaagtcccgcctggaacgcgacggtgtggtcctcatcgacagcctcctcagcaaggacgaggtcgccgagacccgggcgcagctcgagcgctatgagagggaggtgctcgcggacgtcccccgtgtgcactacgaattccatgaggacggcgtactgcgcaacatgacggagatacagcgctacgacgagtggttcaaccgcttcggcaaccaggaccgcttcttcgatctgttccgtggggtcgtcgactgggatccggcgctgttctacctggagaccttccccaagcgccccggctgcaagccgctgcgcatgcaccaggagctgttcgcggggcccgtcgacccgccgcagtacctgcacctgtggatagcgctcgacgacgtcaccaacgacaactcgggcatggtcttctaccggggcagccaccgcttcggcctcgcaccccacatcttccacccggacggtctaccggaggtccagcccgaactgctcgagcgaatcgagcacatgcgcgtggaacccgacatcccggccgggtcagcagctctgttcgacggcggcaccattcacggcagcaaggcgaacatcaccgaccgcaggcgcctgtccctcgtggtcgcggtccggggcagggacaccgtcgtccacggtgacctggacattttcgcgagcatcatcacgcggttcttccgcgaggagatcggcgtcgccaagtgttcggcagaagacgacttctactccctcggaggggacgagcctgccaggagccgggttctcaaacgcatcgtggactactacggcgtcgagctcactgccgatcagctggaccagcggcgcacccccagggcgctggccgagaaactgatcgaactgaccggctggcacgagctcaacacctgaggccgggactccgtcgcacatccgtgcgcaccccgcagggggcacgcgcggccggcgcctcccgggcgccggccgtcccagccggcccgggacctccgggtcgtgaagcgccgaggagccagcttgcttgccgatgacgcacaccccgagcggtccgctgacggtcatccactcatccacgccatgcagcccgtggccggcgacggacgtcacgcccacgcggtagagaaggacatcggccactggaatccgctgcacgcggacggcaacggggagtgagacgatgcgccaccgtaccctcggagccggcggcccggtcgtcagcgaggtcggcctcggcacctggcgccccctgtcgcgggacgggcggcgcggcgccgcccgcctcgtgggtgccgcccgcgacctcggcatcacgttgttcgacactgccggctcgtacggtgacgcggaggaggcactgggcatcgccctgcggggtgcgccgagagagtcctacgtgctgtccaccaaggtctactacgagcccgggggcacggtggcggggctgtcgcgcgcagccgtcagagcaggtgtcgagcgcagcctgcgggctcttcgcaccgaacacatcgacctgctcagcgcccaccggttcgacgaccgcacacccttggcggagaccctcacggccttcggggaactcctcgaggaaggcaagatcgcccactacggattcagtgagtggacggcgcagcagatcgccgcggcctgtgcggcggcaactgaagtgggtgtccggcctccggtcgccagtcaaccgcagtacagcgtcctgtggcgggtcccggagaaggccgttgtgccgctgtgccaggacctcggcatcggcacggtggccttctggcctctcgcacagggcctgttgaccggcaagtacgcgcccggcgaaccgcccccggcagattccagggccgcggaccccaccgggaggctcgtgatggaccacttcatggcggagccgatcctggagcgggtgcaactcttcgccaggctcgcccggcaccaaggtatgacgccagcccagctcgcggtgtcgtgggtgctcaaccggcccggtgtcacttcagcactggtcggtgcctccacccctgaacagcttaaccagacggcgtctgcagccggggtgctcctctcggaacccaccatggaactcatcgacaagatcttcgccggatgtgtgtatgacgatgtcgccggcacagggtaaggggttttgggtagttccttcgcgcctgatggtgtggatctgccacaacgaggtcatgggtctgttggtgtgccggggcggatgaacgcgaattgtgcccgaatgacttgtcggaagagcggtgttcgcggtgcctgtcgcggtctgcggcctcggtctgaccgtgttctgcaccgggacgaccgaattcgtgatctccgggctgctgcccgacctgggggcggtctgaccggcctctgcgccgggtcggcttcaccccactgtgcccgctactcgtcacctccgccggcgtcgtccgtcaaggtgtgacgccgtcgtcgaccacgtggacgccggctgccgggcgcgctgcatgatcagggaccgggatgggaagttcccgcagttgttcgacgaggtactcgaggacgcgggcatcgaggttgtgctcagcggcgtccggataccgaggatgaactcggtcatgaagcggtgggtgcagacctgcgggcgagaactgctggaccgcacgttgatctgggaccggcgccatctcctgcgtgcactgtactgaccctcgtcgttcatcagcgccacgtagctgccgtcttggtcttcgaacggatcgttcacgtttccgcccctcgtggtccgtgacgccgatgccgacgccgcgtcgctgatgccgcgtgcgtaactgctcccgaaccagccgcgggtacgttccgacgcatccgcgagctaggaggaccttgtgattcggctgttccgctgcctcggcgcctaggccctgtcgtccaactcccgtctgccccgcgacgtcatgcacgctcccccaagttctcggctgcgctcgaacaggggggacccccatgacgccgcggggcccgcccttcgggcggacgacgggaatgtgacgacaggacctagcccgcacatcgtgtcgacgcggatcttgcggcccgcatgttcagcgccggcggctgtacctacctcgccgtcaacacgcacaccatcgccaccgtgacccgcggcgacgacctggcggtcggctacgcgagcgccatgctgggcgccgtgcacggcctggtcggcgacgagctgggggcttactccggtgctgaacatcaaccgagtgaagggatcaccgtggagctgaacgactcgaaccggacggccgtcaagccgggcggcacctacgtgcatgcggtcggaaacaccccgcccaactggaacctgctctcagcggtcggcaacgtcgtcgagacgggcatggtgctgcaactgatcacgccgagcccgtacgtcgcgttcccggacctgcagaaccactggaacgaggatctgttggccagtgagccggagctggtcgcgacggacccgcagaccatcgtgtaccggctgcgaccagaagcctgctggaacgacgggaccccggtcggagtcgaggacttccgctacacctggcgcgtgtccagcgggcaccacagccccgcgtgcctgccgtcgacccatgccgggtacgagctgatcgagtccgtggagggcgaccacgacggccgcaccgtcgtggtcacgctcgcgccgggcaaggcgtttcccgactgggacgcgatgttctcgtacctgtatccggcgcacatcgcggcgcgcgccggtgacctcgggacagccgacggtcttgctgcggcgttcgcctcgttcgaccaggtggtacctacctggtcggcggggccgtaccaggtggagcacatcgagcccggcgtcgaggtggtgctggttgcgaacccgaactggtacggccgagtcgtgccgagcctcgaccgcgtcgtgttccgggtggtgagcgacccggtggcgctcgtcgacgcggtgcgtcaccgggtggtgcacggcatgtccaccccgcatccgaccaaggcgctcgtggacgcgttccgtgacatgcccggtgtccggtacgagctgagccaggggctgatctgggagcatctggacctgaacacccgcaatccgttcctcgccgacgcgggcctgcgtcgggcgatcctcacggctgtcgaccgggacgagatcctggccgagaccgtcggcaccttccatccggacgtcaaaccgtcgaacagccacaacttctatctggggcagcccgcctaccgcgacgtgatcaccggcaccggccagggcagtggcgacatcgcggcggccgagcggctgctgcatgccgccggatacacgatccgcgacggccgcctgcggaccccggacggctcggccgtcgccgtgttgcgattcaggcacgcgcccggtgacgtcatgcgccggcgcaccggcgagctggtgcgcgatcagttgcgccacatcgggctggaggtccgcatcgaaccgaccgaccggcccggcacgatggtggccggcgactacgacatcgtggcgttcaattggatcggcagcccgttgcgggtcgggccggcccgtgacatgtggaccaccggcggcggtatgaactttggtcatttctcccacgccgaggtggaccgcctgatcggcgaggcgaacgagacgctcgacttggtcaaggcccacgaactgctcaaccgcgcggacgaggtcctctcccacgaggcgtattcgctgcccctgtgccagaaaccgagcctgctcgtcgtggatgaccgcttcgccaacgtgcgagcgaacccgaccaacgggctggtcatctacaacgcccaggagtggggcctgcgcgcgtgactgcacgggagccgcccgtcgctaccgtcgggaacgtccctacgaggaggacacgttgccgtcgaggccgacactttccaggtcggcggcgatgtcctccggggacgtggctaccgcttcgctccaggtgttgtatgcgaggtcggcgaccgggccgcgtgtgcgcagcgggcgatctcgccgagctggcgggagaacgctggccaggtggaccgcgggtacgtgcgcagtggaacaggcagcgccccacctggtgacagtggtcgtggaccgcacgggtgccgaatgcggctggtacgggctcggccatacggtgctgacgtggtcctggtgatcaatacggacgcggaggcggtcagcgcccgttcttgccgaaccgctcagtcgactccaggatcgcgtcctgcatcgaggggctgcccgtatgaccggagtcgtcgatcactttgagctccgcatccggccaagcttttgacagctcccacgcggtcttcagcgggctgcccaggtcgagtcggccgtggatcagcactgcggggattccggccagccggtgtgcgtcacgcagcagttgtccatcttcgagccaggcgtcgtccgcgaagtagtgcgcgcagatccggacgaaggccatcagcgcatcgtcgggtttgtcgctgtactggcccggcttgccgagtgcctcgtgggcgatgaccgcgtcctcccaagcgcaccagtcccgcgcagccttggttcggaccgcgtcatcgggactgttcagcaaccggttgtaggccgccacgagattgccgtcccggtccgccaccggcaacgcgtcgcggaacgcctcccaggggccgggcagcaggcgtccgacaccgtggtagagccagtcggtctcctccggtctggtcatggtgacgccgacgatgacgatctccgagacccgatcggggtggcgctccgcgtaggcgagaatcagcgtggagccccaagagccgccgtagaggagccagcgctcgatgcccaggtgctcgcgcagccgctccatgtcggcgatgaggtgttcggtggtgttgtggacgaggctgacggccgggtcggaggcgtggggcaggctctcaccgcagccacgctggtcgaacaggacgatccggtagacctcggggtcgaacatcctgcggctgccgcggcgtcctccgccgccagggccgccgtgcacgcacagggccgcctttccgtcggggctgccgctggtctcccagtagatccgattgccgtcgccgacatcgaggaggccgtgcgcgtacggttcgacgggcgggaacggctgggccatgacggtctcctcctggagtcacggaaagcaacttttcgagggtagtcactggctggacggcggcatcgctgaaggggggctacgtgttctgcctgctgttcatgctcctgggccgctgcctgaaatgccccgacggcacccaggccgatccgagcggccagtcaccctccggacgcgtgctcggcactgggcgtcccgccggaacggaccgtcaagacaccggccttctggtttgccgattcgctcgattcggcgatgccacctgttgcatccggcactgtcaccgacgcgggcactgagctgcatcaagtggagcttggtgatgcgcttgccctacctcagaggtaatcgcctcggcctgcctgcatcggcaggattggcgatctctccgcgtcggaggacgcggaccaggacggagaggtcagccatgtccaaagccgcacctacgaacacgcgcaccgtggttgaggagttgctgcgcagaatcggcgagggcgaccccgagcgcatcgccgatctgtatgccgagcagggcgattggaagcttgactggccagaggccgagcacggccgtactgccacgccgtggatccgtcaccggtccacccgggccgacgtggccgcacactttcgcgagcttgccgcgcaccacgtgccggagcacgcggcgaccgaggtcgagcgcatcctcatcgacggaaacgacgtggtcgtgctcggcgagatccgccagaccgcccggcccaccggacgtgcatatcgcgcgcggttcgctctgcacctcaccgtcgaagacggccttgtcacgcggcaccatgtctacgaggacagcctcgccgtcgcccaggcgttcgcgtagcgggtgggcaccaccccttccaccctggtcatcgccgacctgttcggcctcctcccttccaccgcgaagaggtgagcggatgacgcgggcgacagctgagccgactacctctcagccggcaacccaccacccctcgttccgggagcgactactgctcgcgcaggaggctcagccgcagccgcccgaggggttcgtcggcgagaccgtgaagagagcttgggcggcgcgcagttgacgggtttcgggctggtggccaggggcctgcttcgaggggccgatgcgggcgatgcgcctttgaagggagcgacgtgcggcggcttcgccaaccggccgctcccagatcgccaactggagaagctgccgcgtctcagggcgcgggaagccgttcccactcagcgacaggaccgtccccaccacctaccggagccgcccgctcgtacctctcggacccccccaccaccacggtcggctatcgccgccgtccccagaagcggtggctgggtcgttcactcggggggagcacgggctgctccggcagcccgtgcggccgcacctcattcacgcagctcaacgccggcgtcctctccagccgtcgcgatcaacgagtcagtgggaaccgcacgagacgcagcgccgtcctccgccccctctcagacaacgatctccactgcttgcggccttgggaacggcaggatgtcccatccagcccatttccctgaggcctgaggcctgagttcacgggagcgcggcggctcgctaccgctttgaccgggaaggttcaccgggttgcaggaggcgggcagcgtgcgcggaaatccgtttcgaggggtgctgcggtgccactactctggcgcggtgatggctgacgtgatcgttctcaacggtggttccagctcggggaagtccgggatcgtccggtgtctgcaggcggtcttgcctgatccgtggctggctctcgggaccgacacgctggttgacgcgatgcccgcgtccatgcaggcctctgatgcggggatcgagttcgctccggacggagaggtgatcgtcggaccggagttccggacgctggaagcggcatggatcgagggggtcgccgcgatggcccgtgcgggcgcccgggtcatcgtcgacgaggtcttcctcggcggagcggactcgcagcagcggtggcagaaggctttgcgcgacctgcgggtgctgtgggtcggcgtccgctgtgacggtgccgttgccgcaggccgtgagatcgcacgaggcgatcgggtcatcgggatggccgcgtcgcaggcggatgtggtccaccggggcgtggtctatgacctcgaggtcgacaccacacatgccgagtcgatggagtgtgcacgggccatcgccacacatgtcaggtgatcgacggcccggctgcctgtcgaatgacccggcaccgtgctgatcaggccgctaggtggcgggtcggcggccgccacggggctttggggacgcttgtctcctccgcccacgcgacaaccctcccccttgccttgggccgtgctttagccgaaccgaactggtcaggtgtagtcgatgccgctgacagcgctgctgccgtcgccaccggcggtagcgttgccggtcctgtccgtctgcgccgatccgctgccccggccctgcaggcactcaacgccggtgacagccgaacttaccgcccctgcaacatgccgcccctccctcgccccaacgcatccgctgccagtcggctgacggtccactccttgtggcgggatgtagtcggatgggcgcccctgtttcatgacatgggccgcggcctggaggacaagggctctacgcacgtggggaagttcaccgaggacgcggactccgtcggccatgccctcgatgcgcgccccgcgcaccggccgccagattgacccatgatttcacgccttcaatgcaccctcacatgggtctctccggagcctagattcagtggtgtcgccgggaacaccggtcggcgcaactactgagccccaggagtgaccatgacgttcaccagtgccccgaagcccgtcctcgtccgcgccggcgaggccgagacactgcaggacggtgcaaccagcctgatcacgctgctggccgacgcgaacaccaccggcagtgcgctgaccgccaaccgcgcgacgctgcacaagggctcgcccggtgctcccgcacacttccacacccgggcaaccgagatgttctacgtgctcagcggatccatgcggatcctgctcgacgaccaggtcctcacgctcggccagggcgactttctgaccgtcccgccgaccgtgccgcatgccttcgccccggccccggacagcgaggccgagatgctcgtcgtcttcactccggggatggaccggttcgactactaccggctgctggagcgggtgtaccagggcgaggcctcggtacaggacatccgcgacagctccgagcagttcgacaaccactacttcgagagccccgtctggcagcaggaactcgcccggcgctgaactcacgatccgatcgcctcccgcagagcccgggcaagggcggcccggcatgaacccgtcccggccggctcaagggcggtggcgtccgggtcgcaggccggggccgcatcgtcgcggcgaccgccaccagcccgacgcgccgcgcgtgcgtggccacgcggcggtcgtatcggccgctgaccccgcaccgcgcattccgtcacctcgagagcctcatttcgtcggttccccgcacaggggcccagtggtgcgagccagctcgcacgggtcacgattgcacgcagtcggcgaagagggggtgcccttccgggagatcgctgaggccatcggccgtcagttgaagctgccggccgtcagcatcgccaccgaggacgcaggcaaacacttcggatttctcggccccttggtgtcgatagacaacccgacgtcgagcgcgttgccgcaggggccgcctgggatggcggccgacgaaccttccgctgaccgcggacatcaaggacggccactacttgatggctgaccattccagaggtgagccggccgggtgacgcccccgagccgcgctccgtacgagccgctcgacacggcaagccaccccgcggagggccgtaccaccgctctcgggacgctcagcgcttcgcttggcaaaaccgagcgtgcagacgccagggagtgtcggtggttctgagccgcaccaaggtggttctgagccgcaccaacctgcgggggtgggccacggcccaactcggggcggaggcccacagacagacagcttcgcagccggtcgcggccgtggccgcgcctacgcgctgcgccgcggtttcttcggcgtcgtcttcttggcggccgtcttcttcgtgggctccttcgccgcagtcctcttggccgacgttttcttggcgggctgctgcttcgccgtcttcctggccgcggtcttcttccgcggcagctcgtgcacgtccgcctcgccgctttcaccgcgggaggccttcgccttggccacggactgccggagggcggccatcagatccagcaccttgcccggctcctcctccgtctcacgcgcttcaggaggggcgtgcccctcctgtttcgcctcgatgacctcgtgcagggcttcggtgtagtgatcctggaactcctcgccctcgaggtcgtcgcgggtcaggcggtcgatcagctgctcggcctcggtgatctcatcctcggacagctctattccctgcggggccagttccgacgggtcgcggatctcgtccggccagcgcatcgcatgcagcacgatcgcctcctcccgcacccgcaacatgcccagacgctcgcgcccactccaggcgtacttcgccaccgccaccttcgacgaacgctccagcgcctggcgcagcagtttgtagggcttggccgccacctgcccgtccggttgcaggtagtagccctccccgatccccatcgggtcgatcgacgccagcggcacgaacgcctcgatctcgatcgctttcgccgtcggcagcggcagctcgcgcagttcctcatccagcaccgggatcacggtgtccttcgacaactcgtagcccttgccgatctcgtcctgcgtgacctcacggtcctccagctcgcagtacttgcgcacccgaacccggcccatgtcctccaggtggtactggtgaaaacgcacactgtggtcctccgtggcactcaccacgtggatagggacggtcaccagaccaaagctgatcgcgcctgaccagatggttcggggcatggcagacctccacgtcgaactccgagcagcatcagcctacgaaccactcccccatccggcatgccggggtgcgggcatgtcccacatcacgcggcgggcaataccggcagcggaacaagcggaagtcattgaccgttcatctatacgtgtccgcggaggggacggtgtccccggggctcacccctcgcccatggggacgatcgtccggctgaagccccatggagcactcgccgcgaggcgatcgctctccgcacgccaccccctgacggccccggtcggcctcccccgaccggccggggctctccacttcccgcgtcgcccgcccgccgacccgctcaatacgaggcgtatggctgccagtacgtcatcgactgcgtcaccgacagggcccgttaccgcacgctgtggcccttgagccgttcacggactgcggcggccagttccgcctcgacgtcctcgtcgcggtcgaagaccagtgcccccttggtcgggaagtgcgcgaagagggtcgtcgccgataggtcggcctcttcggcgatatcgcggacgctcactcgttcgaagccgtgctccaggaagagctccggggcggcgtcggcaatggtccgcctcatcgcggccttcttgcgctcacgacggccaacggtcggagagtcgggcatggcatcacgcattccgaaactggagcgacacagaaactgtaaccgttgcacttatggactcgtttctgctttggtggtctccacaggggttgccgccccatggaggtcgcgggggtcgcggcatcggccgtcgccgcgccgtggcgtcaccgggacccccgaccgacgaaaggaatccaccgtggactctccgacgcccgcaagtgcgcggatcagcatcatcggtgccggcccaggaggcctcacgtgcgcgcgcatcctgcagcagcacggcattccggtgacggtctacgaccgcgatccggaggcgaactcccgcaaccagggaggctcgctcgacctgcacgaggaagacggccaactcgcactccgtgaagcgggcctgctggaggagttcttcgcgctcgccaggctcgagggccaggaaatgcgccagatggacccggcggggcgcgtccttgaccaccatctgccggacgagggcgagacggtcagccccgagatcgaccgcggacagcttcgcgatctcctgctgcgctcactcgtcgcggggacggttcagcgggggcgcactctcgaatcggtgagcggaccggccgacgggccgcgaacgctgacgttcaccgacgggacggccgttgaggcggatcttgtgatcggtgcggacggtgccttctcccgcgtccgcactgccgtgtcgtcggcgacaccgcgctacaccggggtcagcttcctcgaggcatggttcgacgacatggagcacgcgcaccccgagctttcccaactggtcgggaaaggcagtgctcacatcgccgacggcgagcgtggcctcttcgcgcagcgcaacagcggaggccacatgcgtgtctacatcatgcagcgcgtccccgtggactggatcgcggcgaacgggcttcgccccgaggacaccgagggcatccgcgggcatctgctcagcgagtacgcggcctggtcaccgcagatactccggatgatcactgacaacgacggcgcctacgtcgaccgtccgctctttgccctgccggtgccgcacatatgggagcactcgcccagcgtggcgctcctgggagacgccgcacacctcatgccgccgctcggcgtcggcgtcaacctcgcgatgctcgacgccagcgaactcgcgctcgcactcgtccactcctccaccatcgacgacgctgtacacagctacgagaagtcgatgctcccgcgctcggccgacatggcccagaagctcgaaggcggcgctgagcatcttctgtccgtgcccgactccgacgagatctagctgtattgaccacgagcgttgttaacagtgggcggcggagacgtgatcaaggctggaggcgcgttatgggcaagggggagccagccggagccgtgtggtcgcccactgtctcatctggtggacaccgcttcatcgcacgatctctcctcggaaggttcaacctgcacgagggcgcctgagcgcgatcaggcatgcggcgcgccaccgtccgccgccaggcgcgtgagccactcacgcagcaggcgctgctcggcgtcgctcaggacatcggcgtcgtcggggagggcggcgcgcagcgcgcgggccgctgcggcgggaccggactccgcggtggggactgtcggctcggcgcgggtgacggccgcgaccatggactcgcgcaggacggtcaacagcgccggattgcggcggtccgcaggggtggagtgccaggtggtgaccgccccctggccggtggcctggatgatctgggcggccagctcctcgtcgacccgcagccatcccccggccgccagccgacgcacccgcccatggaggatctccaggcccgcgcggtgtgctgcgtccgatccccggccggtggccctgttcatcaccgcgaacaactcggggcgacagaccccgaactcgaccaccatgtcccagccgcggcgcagctcctccaccgggtcctgcggagcggggtcgagctgcgcgcgctttctctccaggaactgcgcgtagccgtgctcggcgacggcctcaaggagcccctccttgtcgccgaagaggcggtagatcgccggcggctgcattccggccgcggcggcgaccgcgcgggtgctcatcgcgtcagggccaccgttctccagcagctcgacggccgcctcgacgatgcggcgccgaggggtgtcggtggagtcgcgcgtagccatgaaccgatggtaccgaagatttggttccaccggaatttccagtgttaccgttgaagcgattccagcggaaatagtgtcgggagaacccaatgatcatcgtgaccggagccaccggaaagctcggccgccgcatcgtcgagcgcctcctggagcgcgtccccgccgaccgcgtcggcgtcagcgtccgcgacccccgcaaggcccaggacctcgccgaccgcggcgtccgcgtccggcaggggagcttcgacgaccccgcctcgctcgtgcacgccttcgagggcgccgagcaactgctcctcgtctccctcgaccgcacgggccaggagtgcgtcagcggccaccgcgccgccatcgacgccgccgtgaaggccggcgtcggccgcatcctctacaccagccagatgggcgccgcccacgactcccggttccaggcatgccgcgaccacgcccagaccgaggacctgctgcgcgccaccggcctgccctggaccgcgctgcgcaacggcttctacgcctccagcgccctgcagttcctggagtccgcccgccacaccggcgacatcgcccttcccgccgacggccccgtcgcctggaccggccacgacgacctcgccgaggccaccgcggcgatcctcgccgaggagcaccgcttcgaggggcccaccccgccgctcaccggcccggcggcgctggacttcgacaccgtcgccgagatcgcgtcccagaccaccggacggcccttcacccgcaccgtcgtccccgacgacgccttccgcgagcaggtcctggcgcacggcgccccggccccgatcggcaacctgatgctgagcatcttcgccgcggcgcggaatggcgagttcaccgctgtcgactcgacgctggccgagctgatcgggcgagagcccgccaccttccgcacccagctggagcatgcctgggccgaatagatccagtggggcgcgcagacggccccggcctgactcgccgcccacaaaaggctcgccctctatcgcccgaggacgtcgatcaccagatcggcggcctcgggcacaaactcagactccgcatcagattccgcaccatcccagaggtttcccgtgccccacccccatgcccggctgaccgtccacggcagacggctcctcgtcgaccgggtccgcgctggcaggcccatcgcccacgtcgccgaagaaatgggcatctcccgcaccacagcccacaaatgggtccggcgctggcgagccgaaggcgatccggggttgtatgaccgttccagtcgacccctgacgacaccgcaccgaacccctgccgatgtcgagaatcgcatctgcgagctacgacgcgaccgcaagctcggtcctgcacggatcggcccggtcctgggcatacccagctcgacggtccaccgtgtcctgacccactacggcctgaaccggttgcgctggatggaccggcccaccggtcagatcatccgacgctacgaacgatcacatcccggcgaactggtcgacgtcgacatcaagaagctcggcaacattccagacggcggcggacatcggatcatgccccgccagcaggccgcgggcaatcggcaggccacaactgacgtgcgtaggggcggcagtcccgtgatcggctacagcttcgttcacacagccgtcgacgatcactcccggctcgcgtacagcgaggttctgaccgacgaacgcaaagagaccgcggcctccttctggcagcgcgcgaataccttcttcgccgagcacggcatcagcgtcgagcgcgtcctcaccgacaacggctcctgctacagatcccgcctgttcggccagactctcagcgccaccggcatcgtccataagcgcacgcgcccctatcgcccgcagacgaacggcaaggtggagcgcctaaatcgcaccctgctcgacgaatgggcatacgtgcgcccgtactccagcaacgccgaacgcaccgaagccctgacggacttcctccacacctacaactaccaccggtgccacaccgcacttgacggccaaccacccatcagccgcgtcaacaatcctgcgggtcaatacatctagcggttcggtcaagcccagtcctgacgcgcgtcgcccccggctcaacgccggcttcgtcgtcacgacgctggactgccgtcttacgcctgaccacccctatccgacgcccgtcgaggacgtcatcgcggccggggaatacctggaggtgcgcatggacgtggacggcgaaggagcgcgaggcctacgccaacgacctcgaccaccgctgcttccacggctgctgctcgatcggcgacgacaacctgtggggcgtcaacccccgccgcaggggcacggccaacgctctcgcggcacccacatcgatccacgccgcccgccccgatggcgtctcccgccaccccgatgtcctggccgcccaagacgtcgtcctggaagcccgcaagaacttcgatcaccgggccaccccggtcccacaaccccttccacgacggtccccgtccggcagcacacccggcgatcagaaacccgacggaccgtcacggtcaccgcagtggacggcctcccggctcaggctggagtgggcggcaccggaaccgcggacgccgtcgggtgcgccgatgccggtcccgccccaggaggcgcggcggcccgcgaaagcgcgtcatgcacgagccgctccccgtctgccgaccgccgtgcggcaggatggggccatgagcgtagtcaagatcaacgtactgaccgtccccgccgagcaacgggagacgctggagaagcgcttcgccgcccgtgcgcatgccgtggagagttccgacgggttcgaatggttcgaactcctccgccccgtcgaaggcaccgacgactatctcgtctacacgcggtggcgcgacgaggagtccttccaagcctggatggagggccccatgaaggcggcccaccaaggcggcaacgcggagagcggcgaacggcccaagccggcggcgagcggctccacgctgtggtccttcgaggtcgtgcagcaggcggcaccgaagagctcgtagacaggatgacgcgggcggtacagccataccgggccggtacctgctggtacttctgcctcactgtcctgccccgtcagcgcttcgccctgcatgccccgtcagcgccatgccctgcatcccccgtcgcaccaccgtcgccgggggcatgcgggcttgggcatgcgggcttggtctgcgatgaccgccgcgtcaggagcatctgagcacgtcggcaacgagttcgagtttggacatcagctagaccgactcaccgggtgccaggtatcggtagccgctgtcggtctccccggcgagccagccgttgacgctgctgaggccgcgatcgttgatctgggcgtcgtggatcgggaacgcccgttgcggtttgatcgtcttcacgaagtggatcgcctccgccgtcttcatccacgatccctgggccgggaccaggagcgtctcgaccggctgctcggggacgtgcagtgagtcaccggggtggtagatcgcctcgtcgatgatgtagccggggttcgcgcagtccggttggccgccgtagatgaacgcgtgacgcccgccaaccgctcgtacgcggaagccggcggcggtgaactccgcatcggagggcaccccggtgacttccagccgtggaatgttcgcttcggccggggcgtagacgggcacgccgagcccggccaggcgcaggacatcgatgtgatcggcgtgttcgtgggtcaccagcacggcgtccgcgccggtcagggcagccggctcgctccacatcccggggtcgatgaccagcacccggccatcatgttcgagccgtacacatgcgtgggtgtatttcgtgatccgcatggcgtcccaacgtacgccggccgcaccaccccgcgcccgctgatcccaggctgaacaactgcccccttgaccgcgcgggccctgacagagccgatcgcacaccgggtccagtcgagttcgccgtcggcttcccactccatccccgtgtcgccgtcgtccaccgccccgcggacgcaccggcgacgacggcgttacccgctgagtcagctcccgtagaccgtcgggcaccacgcgctcaacatctgccagagagtcccggcagtgaccgcgtggaagcagcggggcgagatgccggacctgaacgcgacgccggtccaggcggaccgtgcgggaactcttgacaggggccggacgagactggagcctttggcaacgttgtcatctcatcgagcacagaggtcacttgctccccactggggctgtctggattcctctggggccatctggattggacccaccgcacatgtcgactcagccgccgcgcccttcccgtcgctcggtcctggccaccggttcaactctgcttgccggcttcggacttggcgtcacactcccccagaccagctacgcggtcacgccgtcgaggcccaccggcgagcggggtgaactcgccacctatcgcccggtatccgtttcgtccaccgactacgcgcccacgcccgccgagttcgtcgtggacaaggtcaactccgtgggcgtgaagggcacaggctggcgtgccgccgacggtgatccgcagtggatatcggtggatctgcagacggactgcacggtcgactccgtgcacctcaccttcgaggcgacggccgacgacccggtcttcgtgccctccaccagcggcaatccccgcgatcgcacgaccggtcaggaggtcctgtccagttgcgcggtggagttcgtcgtcgagacgtcgcgggaccaccacgcgtggaccaccgtccaccggaccacgtccggcaagggcggcatggtggagatcccgctggacaagccggtcaccgcgcgctgggtgcggttgaccgtgaccaaacgctccaacgccaacccgctgggcctcaacggcttcgaggtctacggctcggcggggggacaccgcccgtcggccaccggctggaccgactggggcacccacgaccaccgggcgcccgcgctcaaggcggccgccgacggcacggtcccgttggagtccggctggacgctgaccatggacgactgggccggcgggaagggcgcgcagctgtcccggccggacgtggacacgagccgctggctgccggcgaccgtcccgggaacggtactggcctcgctggtggaccagggccatctgccggacccggtggccggcttcaacaacctgcacattccggaggccctgtcccggcactcgtggtggtaccgacgcggcttcgagctgccgcgcgccttgcgcaccggtccgggccggcacatctggctggagttcgacggtgtcaaccacaccgcggagatctggctcaacgggcagaaggtaggcggtctgacgtaccccttcgcccgttcctcccacgacgtgacgaagatgcttgccgggaacggcgagcaggccctggccgtcaagatcacccccatgccgttccccggcagcccaggggacaagggccccgccgggctcgccttcgtggacgccggcgccaccatgatgaaccagaactcgccgacgtacctggccgcttccggctgggactggatgccggcggtgcgcgaccgtgtctccggcatctggaaccacgtacggctgcgctccaccggccacgccgtcatcggcgacccccgggtggacacgaagctccccgacctgcccgacacctccagggccgaggtgacgatcgtggtgccggtgcgcaacgtgggctccgcgagcaaacgggtcaccgtcacggccgccttcgacgacgtacgggtctcccggtccgtgacggtggccggcggcgagagtgccgacgtcaccttcgcgccctccacgtacgccgcgttgcggctgcgcgaccccgagctgtggtggcccaacggctacggccgccccgacctgcacgacctcacgctgaccgcctcgatcgacggcgaggagagcgaccggcgcaccacccggttcggcatccggcagttcggctacgagtacacggtgccgctgccgttcggcgggagcagcgaccggtacacccagccggtgctcctgggcgtgcagaaggcgcggtacgtacggatcaagtgcctgacccgggccacagattggggcttctcgctgtggaccctgtcggtggtcgacagtacgtcggccggtaccgacctggccctgcacaagaccgccaccgcctccacggaggactccggcaacacggcggccaaggtcaccgacgccgaccccggctcccgctggtcctctgccttcgaggacggccagtggatccaggtcgacctcgggtccgtcgccgccttcgaccgggtcgatctgacctgggagaaggcgtacgccaagacgttcgtcgtgcaggtgtcgacggacggctcgacgtggaccgacgcacggtcggtggacaacggtgcggttccgctgccgttcaacagcggcgccgcgagccttcagacggtggacttcgccgcccgcacctcacggtacgtgcggatcaactgtggtgctcgggcgaccagttggggcatttcgctgtggacgctgtcggtggtcgacagctcctcccccggtaccgacctggccctgcgcaggaccgccaccgcctcgacggaggattccgggaagcccgcctccaacgccaccgacggcaaccccgactcccgctggtcctccgagtatcaggacgaccagtggatccaggtggacctgggctcgtccgtctccttcgaccgggtcgcgatcgtgtgggagcaggcgtatccgaagacgtacgtgatccaggtgtcggacgacggtgacgcgtggacggacgtgaagtccgtggacaacaccccggacccgttgaagatcagcgtcaacggtgtccgggtcttctgccgcggtggcaactggggctgggacgagttgctgcgccggatgccggccgcccggatggacgcggcggtgcggatgcaccgcgacatgaacttcaccatgatccgcaactgggtcgcgtgcagcaaccgggaggagttcttcgccagttgcgacgagcacggcctgctggtgtggaacgacttccccaacgcctgggcgatggacccgccggaccacacggcctacaacgacctggcgcgggacaccgtgcggcgctatcgcatccaccccagcgtcgtcatctggtgcggcgccaatgagggcaatccgcccgaggccatcgacaagggcatgcgcgaggcggtccggtccgaggcgcccgacgtcctctaccagaacaactcggcgggcggcatcgtcaccggcggcggcccctacggctgggtggaacctgagcgctacttctcccccgccacctacgggagcggcgatttcggcttccacaccgagatcggcatgcccgtggtgtccaccgccgagagcatgcgcaacctcgtcggcgacgagccggagtggccgatcagcggcgcctggctctaccacgactggagcacccggggtaaccaggccccgcagaactaccgggcggccatcgagacccggctcgacaccgccgaggacctcgacgacttcacgcgcaaggcgcagttcgtcaactacgagaacgcccgcgccatgttcgaggcgtggaaccagaacctctggcaggacgccagcggcctcatgctctggatgtcccacccggcgtggcacagcacggtgtggcagacgtacgactacgacttcgacgtcaacggcatgtactacgggtcccgcacggcatgcgaacccgtccacgtccaggccgaccccaagaactggcaggtcatcgcggtcaatcacaccccgcggaggctcaaggacgtgacggtcacggcccgcgcctacgacctgggcgggaagcagctcggttcgacccggcgcgccacggtgagtgtcccctcctccgccacggccgaggcattcaccgccgcgttcgcgagctccctgccggacttccacctcctgcgcctcagccttcaggacggccgaggtcgcctcctgtcgcagaacacctactggcgctaccgccgggcatccgacatgaaagcgctcaacaaggcgcggacggtgcgggtttccgccgacatcgggcaggtgacgcgtgcgggatcgcggcgcacggcgacagccaggatccacaaccgcggctcggccgtcgcggcgatggtgaggctgtcacttctggacagcaggaccgacgcccgcgtgctgccgacgctgtacagcgacaactacgtgtggctgctgcccgacgagtcacgtacggtcacgctctcctggcctgccgacgcactcccttcgggccggcccgcactgcgtgtcgagggctacaacgtgccgcggacggtggcccgttcgtagctacgtatcgctacgtatcgctacgtatcgcttctgtgggtcgaggcagtcccaactacgccgggatcatccggctcggtcaccgtaggcggccctgctggcctcgatcgcttgatcgcccgggcatccctagccgcagtaggtgtcccggtgggggcgctcccccgtcgccaggtagtgggagacggttcggtcgccgcactcgttgccgttggcgaggtaggcgtcgtgaccggtggagttcacggtgaccatggtggcgcgttcgccgagggcgttgcggagtttcagggcgccgctgagcggggtggccacgtcccgccggttctggatgagcaggatgttggacgggccgtggccggtgatccgtaccgggggctcctgcggtgtgaacggccaggcggcacagggcatcgcgttcctggtcatgccggcggtcaaggggtacgcggcccggctcttggcaacgtccttctcgtacgcggctgccgtcttgggccattcgatgtcgttgcagagggtcccggcgccgaccgccgcggcgttctgcagcaccgactccggcggcgcctggggcgcgggcggtacggtgccctgctgggcggccaggatcagccgggccaggccggggaagccgctgggcgcgtagaggctgtccagcatggtctggcgcagcacattgccgttcagctcctgcggattggcgccgggccaggggatcggctcgcggtccagcttctcggcgaggcggaggaagagcggccgtacctcggacgccttctcggccagccggtccgggttgccgggcgccgaggcccactcggcgaactcggggaaggtgtcctcgacgccggcttcgtgcccggcgagccaggcgcgggccacccgggtgtggtcggggtcgtcattgctgtccagcacgatgcggtcggtgcggtgcgggaacagctggctgtagacggcgccgacatacgtcccgtacgagacaccccacgcggacagtttctgctcgccgagcgccgcgcggatgcggtcgatgtcgcgagcgttgttggcggtgctgatgtggcggatcaggtcgccgccgttgcgtgcgcaggcatccgacattcgctgggcggtgaccatgttttcggtgatcgacccgtcgggggcgggccagggccgtagcttcgaagtggcgaggtcgccgtactcgaggccgcaggtgaccggggtggagcggcccagccccctggggtcgaacccgatcaggtcgtacgcgtcccgcacctcctgcggcagcttttggcctttgcccgatgggttgttgaggctggagccgccgggcccgccggggatcaggagcagtgcgccacgacgcgcctgcggcttctcgctgggaatccgcgagatggccacgctgatcttcgcgccgcccgggttggcgtagtccatcggcacctcgagagtcgcgcactgctggcgggggtcgagcccgcttccctcgcatgtcgcccagtccagggggcgggcgcacctgtggtggaagccgtcgcagtgagtggcgcggtgagactgaggacgaccgcggaggcggcgagaagggccgcgtttgtcttgatcttcatcatgcagacgagcttcgctgatgctccgcggcagccccatcctgccaactggcctgtgtgcacgggggtttaccccatccccaaccccaggccggcctgacggctcatggagggtgcctcggagcctattcgagggtgttcgagctcctcccgatcacccgtttggtgcctaccaggactcggtaacgctcccgtgccgcgaagtcggccaggccccacacggtcgggtgtccgacctccgcgcagaggtggaggactgcgtcgtcaccggcccaaacgccgacgtgggcgccgtaggcactggcagaggcgttgaagaggagcaggtcgagtggctggggggccgaaacacggacggtggtctctgtgtcgccccacagttcgctggagcgcaagggtggcggggtcaggccgaagagcccgagcacctcgtaagcgaacagttggcagttgccgcccgccgtgaggccgggctgatcggccacggtggccgcccctgggaaacgtgctccggcgtaggggacggtccagaagtcggccggaagccggggcaggatcggttccatatcgccatgatgtccccggccgctgagggccccaacccatattcggtgagagtggtcggacttcggcgagaggggacgtcccggtccggagcctgcggccgcaaccccgaatccgccgagaggcgcgtgcacttcatcggcacaggggcctgtacgtcggtggtggccagggggcgtctgaacgtcggtggcggccagagtgcgtccgagcgtcggtggcgggcagggggcctctccgtgatcctctggcgcccctaattccttcgacagagtggaatcgagctggcaggctgcgcgcatgatttacggaatcgagtcccgccccgcccggtgagcgcccaggaagagcgcgacgcgctcaccctcccgcttgccctgtacgactacgccctgcacctgctgcgggagtcccgcgacggagtcccgcccccgcgtggttactccctcccccagaggcccgaacccgacgaggccccaccgtcccacgaagcggcggagatcgccgtccgggaagcactgagcccactaccggaagactccgccaccctgcaccgccgcttcgcccggcacggcatccgggacctccacaagcacctgatccggtccgccgtcttcaacctgtcgctgccgaacgggcagcatgacgcggcccgttcgctgggccgacagctgacccggaccggcaccaccgtccccgccgtcaccgcgggccttgccctgctcatccgatacggcgagcccgaagacgtcccgtatctctccgccctcggcctgctccgggagttcacccgcccggcggtcgacgccctcgaccccctcgaccgccagtccgcggccatcgtctggcttgtcacccacaccggccgcgacgaactgcggccactccttcgcgccctgtggacaggggatcagcaagccatccgtacggagctggaggcgttccctgccacacccaggttcctcagtaccacggccgcccgccggatcgcggaggccacccggctgcccgatctgcttgaccaccacccctccgacgctgccctgctcgcccgggcgggcaggctcctcgtgcggatgggatgcacgcgcgacaacccgaccgacctccttgtctaccgtgacgcgctcaccgtgtacgaacgtgtcgtcacacgggccggcctcctgccgccgaccctcgaccaccacgccaccctgctctcgctcgcgctggatctgagcagcggcccaggcgtgctgctggactggcctccgggccggcgcgcggcgctgttggaatcactcgggctgctgctggccgaaccccgatgggcctcgctggcggacaccggcgcaggcgaggcggaccagcggctgcgggccggctggatccagcgcactgggcggcagcccttcacacgcccagccacgcccggcaggctgcgcgtggaggtcgtggcgggcgaccccgtggaccgggaacctgtcgagacccgcatcctggtcgacgggcgtcctctcgtcccggcggtcttcgcccgcggtcccgcccgttgccccgagtacctgctggacgagggccggctcagggccgggccggagccccgtgaggtacagctcgcagtggcctcctgcaccgaggggtgctgtggcgcgctctatgtcaccatccgacgcgacggggaccaggtcgtgtgggagggctggcggcggccaccgaccatgccgggttcccgggagcccgcgcccgcactgcctgcctaccggttcgacgccgccgcctacgacgcggaggtcgcccgggcggagaccgaccgctcctggccctggccggcccgcagcacggcccgcctgatcaaagcggggctgatggaacggccggagttgctgagccggtgggatgcccgtcggggctggatcagcagtggcttcgacgacccggacaccaccgtggtgaccttctggtacgtgccgggactcgccgccgggaagccggtcggcgacccgctccagttccgctgggtcgtgccggacgacggcacgccgcccgaggcacaggccgccgccgccctgcgccggctggccgaggaggacccgaagacctacgggcaggtgtgcggcggcagccgcgaacgcgccgaagagctcgggttcggctggcccgatcgcgcctgagcagcccgagagcgtccgtaaccggggtcaccggggtccgaaccgcaccgacacgcacccatgacctgcggatcgccgacacacctggcgaaccgccggccaggatctcccccgctgtcgccgtgccgacaaccgaacgccgtgcagaactgtctgaaacgccgtggcaccgaacttgagcggacggtgcgaggtgcacgcgcggcgacggtttggccggcgcctcccgacaatgccgtcgttgccgggcggtcaccccgccagggcgtggcctgctggtggagtcggctcagatgccgaaggcgccgccctggacgaggatgagcaggccgatggtgatcagaaccagcggcagcaggacgtggccccagcggctgagggccttggcgatgaccgggcgggtggcgaagaacctgcccgcgaagcaccagatggcgaccaggacgagaaacacgacggcgtacacgctcatcccgccgacgccggcggtggcgaacaccgggacgtagacaccgatgttgtcgcctccgttggcgaaagtgacggccgcgacctccagcgggctcggcccgcctcccttggcatcagcttcctcggtgtcctcgccgtcgcggtggttcttccaggcctgccaggctgccttgaggcccagggcgagcggcagcagtccgaggtaggggatcgcagattcgggcaggaacgtggcgccgaacgccgcggcgatggccacggcgaggatggcggtgaagccgaggtactggccgatcacgatcttgcgggtggatccgcggtgcccggcgccctgggcgaagaagagcgccaggatcaggatgtcgtcgatgttggtgacggcgaacagtccggctgcctgcccgatgatgcccaggttcacgaaccagcccactctgctcagacgccaatgactggatgaccctactcggggcccttgggtcccttgggtccctcggggccctcggggccctcggggccctcggggccgaacgaggagcggtggccgtcctcgcgagcctgatcagacttggctgtcacaagaccggccggtggtccaacttcggggcgatcggtccaggttcgctgtcaccgtacaaggtctgctgtcacggaaacttgccccctgctgagggttacatcgagtttcgcgaagggtcaccgcgtggtcggcgagtcgtcgccgcagcccatgcccgcgtgacatgcgttccgataagagtcctcgtaaacgcgctccccgggagctttcaggcacagcgtggtcccgcagatgacgatgaacatcacagcctggctgacagcgaccgcgcgcatgcgccggatcccggccacggccatggcaaccagggcggcgatcggtacgaccgcggccttcttcaggtaggggcccggcgggtcgccatgatgctgtgggtcccatgaccagtaggaccccatccaggacaggccgatcaaggcgaggattgccatctcgacgacgaccagggccacggccagtcccctaccggtgcgttcagagctcacgtccaccaagcgaccatcacccgagccgatgcgccgcgtcgtgagtacccgtactcaaatgcgccgtcagaggacaggaagtccttccctcgcaggctgtcctgcctgaacgaaggccaggccgcggccgatgcgatcgcgagggggtggaagctgatcatcgactgaacaggtgtgcttggcccggggcgatgtgcggtcggctcaaccagggcccggtcgaaaccggtcgacaccggtcggcaccaatcgactgcggtcgctgctggcggtcctgccgctggtccggccggttcccggacggacgtccggtgctggcggtggacgtctcgtcgtggcttgggtcggacgcccgtgctcgcgggagggactggtgtgcacgtctacggccgggcgaagacggcctcgcggttcatccctgactggccgtagtctttcttcgccgtgctggagatgggcgcccctcctggacacaggtcaaggccgaattcgccttctggagcgggagttggccgagaacccggtcagcagcgaaaggcgggcagtcgtcggtacgcagaacgcctgccccgccggaggcggggcaggcgtcacgatgcagctcaggcgggggtgatgttctccgcctgcgggcccttctggccctgggtgacatcgaagttcaccttctggccttcctgaagctcacggaagcccgagctggcgatgttcgagtagtgggcgaagacgtccgggcctccaccgtcctgctcgatgaagccgaagcccttttccgagttgaaccacttgacggtaccgctggccatttgccctccaagggacgtgaaagtcggttcccgcaccgcgcgggaaccggaggtgatcgccctggtcctcagaggctttgaacagcaaaacgcccgtgaactcgcgctcacgggcgaccggtacttcggaaccatgacagctagaccagacgctacaccgagtcttcgctgcgcaccacgggaattccagtctcgtgtggtgtaaagatcaccgctgtggagcccgcacagctacgtccgggccgcagggccgctacgtccgggccacaaggccgcccatgggtgagttcgcagtcccgcgccgcgcaccggctaccgcctgtcggccgcaccccgctggcctcgcggtgccgagacggcagtcctgcgccgccaacccatccgcgcccgcatcccttacccgcgaccagccggcagcccacgccgaatttccatgttcttccacctctcctgtcttccaggcagggggagaggcagacgcccttgtgttaccggtcaggcggcaaccggggccgggacaggcagtgcccgccgtacgtgggagcacagcccgtcctcccccttcgtcggaaggcgcatccgccgcttgaaatcacgtgtggttggcagacccagggcgctgcgccaggccataccgggatgccggaaccgtaggtgagccagggcccgggcgcccagtccagtgtcatggaagcgctcctcgatgaccacgccggtgaccacggcctccgcacacgccgtacagatgcggtagtcgacccgcccgacgactttgcggacgtggacaaggagcaggtactcctcaccaccgccggtatcccccggggtgcgggaggacaggaactcgacatcgcggtaggcgatcatccgaaggcgtagtcggccggtgatccgagccttccgccggtgcctgccactccccaggccgacgactggtgtctcgcccgcgggggccgggttgaacgcattgctcgtgggacgcgcatggagtgctggcatgaatgcccgtgtgcccaaaagctgcccttctagcccttcacggcccagatcgacaaagagccgacggccggccggttccaggaccgctcaagggaggcaacggatgcactgagatgcactgactgcaccccggtggtggctgatcacgagccgggcggacttcttgtcgaagtccttggccctggcgaccttgaggtcagccatgctgtcccatcggcggcgaggccaagggcgacggcctgccccagactccggccttacgcaggtctgatgatcgttgcggtgacgcccccagcccgggaggaccgggaggcgaggccgggggcccgggggcggtcctcctgccgccggtgcacctcgacatcctcggggtcctcagccgtctgtccagcgccggacatcgccgtcggcggcgccacggccgacgctgcgcattcggcgtccggcgtcgggcgtccggccgcaggcaatcgacgtccactgaagtgggcgcccgccccgccactccaccccactgggatcgtcgagcagctcgccggggtcgggcgggccggcggcggcctcgaggaacaccaccaggtcgtgggcggagcgagccaggcccagcatctcgtcccggccgcctctgtgcgctgatctcggcgcggcaaactgatcttggcgcggcgggacgggccgcggtcagcggcttcgggttgctccccgccgccgttgcgcagacgaggaagaaggcggcgggaaggcctccccctcctcttcgtcttccagtggcgacagatcgacggtgtagagcggctggaggaacagatcgcggtactgcggtacagctggcgagcctgctgcaccgtgcaggggacgcgcgggatcgcggtgggaagaggcagcaggcatgcacaaccatccggagtcgagggccgcgcgaatccaaggggagccatcgacccgtgactaccggtatctgtttgctccgcgcgcggtagccctattagaccctattggcggtcggcaggacgtcagcgggcggtgtgagtggctgggggagttgcaacatcgcgtggcgcgccgccgcccgcgaagggcggcgaggctgcccagcccggccatcgcgaggccgccaggacggatcggccgagcaccgggtgcacgccgacggccagtgtggcggctgcgcgaattgcgttgagacacaggcgccctggggtgctctcgatgtgccacgcccccccgtgaccgcccgcttcgcctacaggccggtcagaatcgtcatccccaccgtcttgacctgtcacgccgtccgtccccacccccaacggacgttccaccgtggtgacatgacgggccacagctcacgctttcttctacattgatgtagatttttctttcggtccaccccgctcgggcgcgtatgcccggtcgacggcaacacggaggagagcagcgtgggagtttccctgtccaaaggcggcaatgtctcgctcagcaaggaggcgccgggcctgaccgcggtcctcgtcggcctgggctgggacgtgcggaccaccacgggcaccgactacgacctcgacgcgtccgcgctgctggtcgacacctccggcaaggtcctctccgaccagcacttcatcttctacaacaacctgaagagcccggacggctcggtggagcacaccggcgacaacctcaccggtgagggcgagggcgacgacgagtccgtcaaggtgaacctcgccgccgtgcccgccgaggtcgacaagatcgtcttcccggtctcgattcacgacgccgagagccgcggtcagagtttcggccaggtccgcaacgccttcatccgcgtcgtcaaccaggcgggcggtcaggagatcgcgcggtacgacctgtccgaggacgcctcgaccgaaaccgcgatggtcttcggggagctgtaccggaacggcgccgattggaagttccgcgccgtcggccagggctacgcgtcgggcctgtccggcatcgcctccgacttcggcgtcaacgtctgacggcaccaacaagccctcagcgcccacgcattgatccccatgctccgcccgcgcattgatccccatcgccagatcgacacgatctggagctgagcgcgggcgcggggcatcctccgcgcgcatcccgcggttgggtgacgacagggcctcccggcgctgtcgtcacaccgatgccctacaggcggggagtcgcctccaaacggccgtccttccgacctgcgaccgcgcacagggcgacgccgaggaccgtgttgccctgtgttccatagcccgggaacgagatgatgtcacccggggaagcgacacggcaggggacgttggctccgtcgcgatagacgacagtcacgtcatacgcactcgagcagtcgttggtgacaaacgtgtagcgccagtccgagttgatgtgcacgcaagcgggcgggctgtcccagccttcctctgcctcgcgggatgccgcctgcgccgccacgccggacgacacggcgagcaagcctgccgtcagccccgtgatggttgaacgaatgaaccgcctcatggcgctgtttcccttcacttcgtgaacaggagtgccatcagcgtacgaggggccgagcggctctgaaatattttgcgacaactttcgcaagaaccggaggaccgcgcatccacgtcccggtgagcgggtggtgtccgaacccccagctgagggcgtcatgttcaggcgctgggtctgaacggcgcctcggccgggcgcaggcgacggggagaactgtccccgtcccctggtgacgcggcaggactgaatcctgtcaccggctccaagaacatcaactggtgaagcccgcgcggatcgacctgaagcgatcggccacgccttcccttcggccgccgtcctacgaccgtccccgcgccggtcgctcggcacggggacggtcggcacgcggacggtcggcacgcggacggtcggcataggcgcgttcagcgcttgaacaccgccaccgtgcggcccggcacctcgaaggttcccgcgctcttcgtgtaggtggcggtcttgaccacgcggtccgcgccggaggcctcgggtgcagtcggtatccggctccggccagttccgtcacctgctgcgactgccggttcggagtggcgttgaagacgacgaccagagtttgccgcacggaagggcactacaccggagaccatcctgctgtggtggctccagcgtcatccggccggcatcgctccggtcgtcggcaccacccgaccggagcgcatccgcgcctgccgggacgccgtacaccgcgctgtcgatctcactcatgaggagtggtacgacctgtgggtggccgctcacggtgccccactgccctgagcccggacaccgggcaatgggcagcaggcagcgggcagcgggcagcgggcagcggcgacgcatccgcgtgcccgctcacccctttcacgcgcctgacatgtacaggtaatctccataagcctgcaagatattgctgcaaatttcagacaggcgatgcgttgcaggcgtgggtgcatcactttccccacagcgaccctggagacgcgcatgagacgccatcgaccactcgcccgcccccgcgcggcgggagctctggcggcaggcctcctcgccctgtcggccacgacgaccccctcccccgcctcggcggccgccgccgagcctgcggccgccgaggcgaacacggcgaccgtcttctactacacgaagaccaagaactggcccgccacgtacctgcattacgccccggacggcggctcgtggacggccgcgcccggcgcccggatggaagccgcctgcacggactgggtgaagggaacaggcccggacacacgccccggtcagcgctgctcgaagtggccggggcgcgcgtcccggtgcgtcaggctgcccagttgtgcatgcggagggactcgggatcggttcggcaggcacggggtgtcggtatccttcctccaggccctgagggcaccgacacccctccgctcaggcggccagagcagccgacgcgtcggcctcggtcagcagaccgatgagggtcgcccgggcgcgggcgacccgggagcggaccgtcccgatgggacagccgctgacctcggccgcctccgcgtagggaagccccatcagctgggtgaggacgaatgcctcgcggcgttcgtcgggcagcacggccagcagatcgaggagcgcgatgccgtcgtcgaggccaggcaggtcgcacggctgggccagctccaccgccaactgccaatcggggatatcgctcagccgcggccgggcagcggcatgccgaaaactgtcgaccacggcacggcgcgcgatggacatcagccacgcacgggccgaggaacgtccctcgaaccggtgcaggctgccgagcgcccgcaggaatgtgtcctgggccaggtcgtcggcggcctgcgggtccgcactgagatgggcgacgtagcgcacgacatcgcggtgcagggcgcgtacgaaacgctcgaccgcctccgggtcaccgccgcgggcggccagcgcccatgcggtgatggactcgtcagccgacgccggtcggtcgtatgcggcgcgcgaggtgggcagggcagaagtgatcaccaggtgtccttctcgggtcatccgtgatccggaccggcacgagggcgcggtggtccggggtgggggacggccgtacgggaggtacggccgcacgagtggggtacggccgtacgggaggtacgaccgatgcccgaagcacccacagaacggaggtgcctcggggaaccggctgtctcagatgacagcggtccccacgggcgggccccgagaagtgatcgcgtgcacgagaaggagtcgccgcggcgtccggtccgaggagcctcggcgtacgcggatacgcggacggtgcgccggcgtcggcagggcgagcagcagccgcagcggtgccgccaggcggccggccagggctcgcaggatgcggaaggcggcacgctcgccgtacgccagccacagcccgcacagcagcgcggccgccgagtgagcggcgagcatgccgaacgaggagccgccgcccatgtcgtggcccaggtgagccaagtggcccgcgcccatgttccccatgtccatggagtccatgtgcacggagtccatgtgcacggaactcatgtcggaccccatggagcccttcggcatgctgtccgcgccaaccgagcccgcagagtgggcagctgactgagcgacagagaacgccgagtggagcgccccctgggcgacaaccaccacggacacgatcagcgcaagcccccgctcacgaccggccaggcaccagcccgtgccacccgtcaccagggccgcgaccgtcatcgcccaccagggcactgcggtaccggacatcatcacgtgccccagggcggcgagcagcacacagacggccgcgaacaacgcggcccgtaccgtgcgacaacaccacccagcagtcatgacggcctcatctttgcatccgaggttcggtcgtcacgggtgggtacggaaatcagccgggtgtcccgtcaatcgcggacccgtgatcaagaacacggacatgtgcgggaacccgtcagctctccgctcctgccccgcgtgtccggtactcgctccgggttcgcgcggcaggtcggtggccagggccaggcgccattcccgcgggtaggccatcggcggctgtccggcccgagcggtgaagcgccgggccgggttcgcccgggacgcgcccgtcttcgtacggtcaccggatcgctcccgatacgggcttcacgttcgacgggatccctcagcggtcctgcctccgcacggcgtcgggggtgacgggcgtgaagaagttgatcagattcccgtccgggtcccggaagaggagggatcggttgccccacggcatggtcgtcggcgtctggacgaactcgcagccgaggggcgtcagacgctggtattccgcgtcgacgtcggcgacgcggaattcggtgatcagcgagcgattggatgccgggcgggcggaaccagagccgaacagcgccacggtgcggctgctcgcgaccgccagcgtgcacgacggcgtcacgatttcggcgaagtcgggggtcgaccacgtcgccgaaacggcggtgacctgttcgtagaactcgacaagacgagcgacgtcgtcggtgatcacgcggatcgaaacgaagttcatgagtggcttcctgcctggggtggttcggttccgaatggagggactccgcgtacgctaggggcaataccggacagtttccgcccggtatccgaggcagacttcgtgggtgactacatcgaccgcccgagtgctggccctgctggagatccttcaggaaggcggcatccgcaccgtccctgacctggccgcccgcctgaacgtcgacgaacgcactgtccgccgttacgtcggacacctgctggatctcggtgtgcccgtcgactcggtacgtggccgttacggcggctaccggctcgctcctggctatcggatgccgccgctgatgctgaccgacgaagaggccctggccattctgctcggcctcctggccgggcaaagggccggtctggtcaccacgtcggccgcggcgagcgagagtgccgcggcgaaactgcggcgggtactgcccaaagccctcgggcggcggctggagtcgctgctggagacggccgacttcacggcgcgtccccgttccggcaccgcaccggaagcaggtgtcctgctcgacctcgccgaggccgcacgtcatcggcggccggtggcgatcagctacaccgaccgaaagggccgcggcagcgaccgcaccgtcctgccctacggtctcgtggcgcattccggacggtggtacctgaccggcgccgacccggccggcggcgaggtacgcaccttccgcctggaccggatcgctgccatgaccgtgcagtccggttcgttcgtcgtcccggcgggattcgacccggcggccacagtgctggaaagcctcgcgcacacgccgtggacccacgaggtgtctttgcgcattcaggacagcgtccagcacatccgcagccgtctcccggcggacatcgcgaccctgtccgtgatcccggccacggccacacccgacgacgccaacctggccgataccggcgatacctcgtccgacggcccaagtgccctcgcggcagccgacgaacgcgtcggatgggtccacgtcgggatccgggccgaacggctggactggattccccccgtactcgccgccctcgaccgcccattcgtcatcgaacgccccgccgccctgcgcgatctcgtgcgcgcgctcgcccgccgcctggatgagcacgccactgccggctagcgccgtagcaggcaacgttcgctctattgctcttggcaggcgatgggttgtcaagacagactgcccggcatggagttgatcgcacgggggcgggaagccgatgtgtttgccctggacgagtccagggtgctgcgacggtatcggtacgaggggcggccaaccgatctggaatcacgcttgatggctcacctgactgcgtgtgggtatccggtgccgaaggtgtacgaggtcagtgacagcgacctggtgcttgagcggctgaccggaccgacgatgctggaggccctggcacagcgcccgtggcgggtgcgtgggctcggtcgaatgctgggcgacctccacgatcgactccatgggctgccggcaccggcatggctgcccaagcggttcggcactggaggagatgaccgggtgctgcacctggacttgcatccaggcaacgtcattctgaccgggcgcggccccgtggtgatcgactggagcaatgcgggcgctggtgatcccgctgccgatgtggcgatgaccatggtgaccgtcggcagcgccgacgtccccgggctcgccgcacgtctggggcgggggctacttctgcgagctatccaggacggctgcgcaactgatcccaccccgcgggtccaggaggcggtcaacgccaagctggccgacccgaatctcacaaccacagaggcagcgtggttgcgaaaccgtgctgctgtctctgccggtccctgaaaccggcgcgggcaccagcactggacgaggtcgccgtgtccggcgctgacgcggtgacttgcccacggagggcctgacgcgggcgggtgcatcggccgggctgctggtccaggggcaggccgttgcggtcgccgaggaggtggattttcgactcgagtgctcggaagtaggcgacgctccctgctttgatgcgctccaggtcagccacagcccatcgtgccggcgaacgagcacggttgcgccgttccgacatccacgagtgaggccaacggcgccgaacgccagagctcctgcacagtcgggcatgaccagcgtggccggatggtttcccggcggtgccgagaagagatcgaactcctgaggcggtgctcagctcggtgcaacggtagggagccaccggagatccaccggggcggtcatgggctcaagtcgagctgtgtgatgatgcataaaaaatggccggccctggggagggcccgcgtgcgcgagaagggcggggcccgtcgtgggcaagggtggggagtccataccggacgaagagtgggagcgcttccttcgcgaagccgaagcggggaccgagggcgcgcccgaggagccgtcggcgcgagcccgcatggcggcgcggcgccgggaggagaccgaccgaccggagccgaggcggagtcatcaaccggcccggcggcaaagaggcaagggctggtacgcgatcggtctgctggctgcggtcgccctgctggtcgtggctctggatccagggcgggtgactggatggttcggcggcgggggtggcgagagttcgccgctcgccgtggaatcggaacgcccggatcaaccgccaccgacggaagcagcagcccaacaagcgaccttggaggagccgttcaaggggtcgcccgcggcgcagtggggtgacgggacggatgggatcggtctgcccaagccacaggcgaccggctggatgagcaaggcacaggtcgcacaagcactcgagaggacccgggacttcctcaacgcgtccagtctggatcctggcgtgctgcgcggggacaagccgaagaaggcgatcgcgttgatcaatcctcatcagcaggatgtccaggactacctggcgaccgcgttccgttcgccaagccgtgagaacgatcctcggctgctgttcagtcggttcgagaaggcgaaagtgcggcttgtcggggatgtggtcaagacacgagggcggatcacctaccgagaaggcaagcgcggtgcggtcgaggtgaccaccgacgtcacgtacgtatatccggtcgtacgcgctgcagcgggaagcgacgaagtcgcgcgcacgatcgtgcgccgtgaggtcgtgatgagttgggacgacccggcgaaggtcgtcatcgagccgggtacgttctccctcgtctcctacaaggtggacaccaccaacggcggctgcgataccctcaccggctacctcacccccaagttcgatgcggagcgcgcgacttcgagcccaggagacggccccgaggtcgacccctacaaccggagcaagtcgatggagacgcgcatgcgagaggccggcgatgcggggtgcggaacggccacccgatcatgaacggcagttgtaggggcgccgtcgcgagcgccgtgataccgccgcccgggccagcggaatctcttagtgatcgagcgatgatcggtcgtggcgacggacccgcgagggcgctttgccgtcggggggctgagtagtgccccacgcgctcggccgagaattgacagttcgttactcgctaccactcggttctctggtatgtctggccgaaacggtcgaaacctgacagggcacacatgccacacgcttccgaattccggaccaagacatatttgcgttggagcgcagtccaactcctaggttcggaagcatgcgatacatcaaactcggaacgaccggactggaagtctccgccatcaccctcggctgcatgagcttcggcgagccggaccggggcggcgagccctggtcgctgggcgcggacgccagtcgggacatcatcaagcaggccctcgagggcggcgtcaacttcctcgacacggccaatgggtacagcgccggaagcagcgaggagatcgtcggccaggcggtcaaggacttcacccggcgcgaggaggtcgttctctccaccaaggtctggatgcggatgcgccccggcccgaacggcgccgggctgtcccgcaaggcgatcttcgccgagctcgacgcctccctgaagcgactggggaccgactacatcgacctgtaccagatccaccgctgggactacgacaccccgatcgaggaaaccctcgaggcgctgcacgacgcggtcaagtccgggaaggtccgctacatcggagcctcttccatgtacgcctggcagttcgccaaggccctgtacctggcggacctgaacggctggacccggttcgcgtcgatgcaggaccactacaacctcatccaccgagaagcagagcgggagatgatcccgctctgcgccgaccagggcatcggcgtgatcccgtggagcccgctggcgcggggcaggctgacgcgggcccgggacaccgccacggcgcgtgccgagaccgacgcgggcggcaagatcctctaccgcgacgaggaccaggcagtggccgagcgcgtccacgagatcgcgggcaagcggggtctgtccccggcccaggtcgccctggcctgggtcatgcgcaacccggcggtgacctcgcccatcgtcggggtcaccaagccggcccagctggccgacgcggtcgccgcggtggacgtcgaactcgacgaagacgaggccgcctacttggaggagccctaccagccgcacgaggccgcctacctggaggagtccttctacaagcggcagcctgtggcgggctcccggtagtccgggctaccgccgggccttcgacgagtccttggccccggccttcacagccctgtggtcggcccggcggtgcttgcgggcggtcgcgcgcaactgcatgatccgcgcgctgcccgccagcgtggtgagcaggatgcccccaccgcggccagcagcagggccacgcgcagcgggacgtgcccgtgggcatcgaagtagctgacgtccaccgactgctcctgagtttggtcaattggttaacttgatggccctcttgccgtactgatccgtgtcgcgatctggctgaagctgggcatgccgagatcgatcacttggtgttgacggacctgctctgcgtcaagctgggtgatcttctcctctgcgctggccaggctgacttgcagtccctcgatctcaccgagccatccctcctgttcggcttcggtgattcgggcggctctaggcgctcggagtgctggcgcgcggtgttgaggtcggccgcccagatcgcgtcacccgcggcatgctgaatttcctgggcgagttcacgcagaccctcgttatggacccgagctgccaagagttgaagttggagcagagcctccgaccagccttcagccgttggtgtctcccactcgcgggtaggccacgagcctgattcgtggaactcgatgagcatccggtcaagttcttcgtagacggccttgaacaggttcgagcaagacggacgtaatgaaggagccgagtaggacccccacgaagccgaagatcgcagaagccgtttcagcagtctccctttgctgttgagtccttcgcgcctctggatggggtgggaatgccgaggtcgacgacggcgtgactgccgcggcggcggtcgagctgggcaagtttctcctctgctccggtgaggctgacctggagtccctcgacttcgcccagccagccttcgcgctcggcttcgtcgatgcgcgcgatgaggttgtcgcggatgtcgacgagccctgtccgttgggccggatccggtcggaggagtgagcatctgacacaagcgtgctcatgaacacaaggggatccgaaggcgcgagcgcaggtgccgatggacaccttccgcttctcgaagtgggcgaggaaagcgtcccactcctcctcggtcggggttcggtagcctcaggacatgctgccccggcacaccgtccccggggccggggtgcggcccgtgcggaggtagtggtcgaccgtctccttgacgcagcggttctgcgggtaggtgccgtggccctcctcctcggccgtcaggaggacgccgacgccgtcgcccagggcgcgggccatgtggcgggcgccggggtagggggtgatcgggtcgccggtgccgccgaccaccaggacgggggccgcgccgtcggcgttcacctggagcgtggtgcgctcgccgtcgaacggccagtcgtaacagaggtagacgccggtggaccaggcagcgccgaagacgggtgaggcggctgtgacgcgggccttgtcccggtcgagacgttcgaagtccgggcgcaggctggagtccgcgcaggtgatcgcggtccgggcggcgtggctgtcgtcgcgtggggtcgccgctcggtcggcggagccgatgtcgtccgcgctcttgctcagcggacggccgtcgctgtggtcgatcagcgcggtcagagccttggcgagcggcgcccagccgtccgtgccgaggcggagatgctcgctgactgcgtgcgcgaggtcgtcggcgtcgaggttccttccgccgccggccggggcgggcttcttcttcagacggtcggccaggcgcgccatgcgtcgagcggcctcctcgggcccgtcgccggtcgggcagtggcggatacgggcagcgcagtgcgcggcgaaccggtcgaacgccgcctggaccgccttgacctgcgacacctgctcctcgtcgaggtcctcggtcggatcgacggatgcttcgaggacgagccgtccgacgtgcgacgggtacaggtgggcgtagaccgcgccgagcgccgttccgtacgagacgccgaagtagtgcagccgctcgtcgccgaggaggtagcgcatcaggtcgaggtcgcgcgcggtgtgcgaggtgccgatgtacgggaggagcgccccggagtgctcggcgcaggcgtcggccccgtcgtccgcggtcttcccgcagcgcacggggatggtcgcgccgacgccgcgcgggtcgaaggagaccaggtcgtagcggtcgaggagcggctcgtactggttgaggaactcgggcagtccgctcacgccggacacgccggggccgccgaagttgaggacgagcgagccgatgcgccgggcgttcgggccggtggccttgcggcggatcagggcgacgtcgatcgtcctgccgtccggtttccggtagtcgaggggggccttcatggtggcgcagtcgtagcccgtgcgcgcggtgggcggcgaggtgcagcgggaccagcggaggtgctggccggtggtgagcgcggtgggcagaccggcgggcgggttgctcgcggtgaactccgtacgcggctccgcatctcggccgcgagcgtcgtgctggagccaggcgctgacggccccgatcgcgacgaggacgaccacggcgatgatgcgcgcgccgaccgagaggcccggttcgcggcttcgtatcggatgtgcgtcactcatcgaaatccccgcgctcccgcccctggacgcccgccccgtgcccgcatgcccggacccgtgatcgtccgatcgtcgaatgagtgcagggtacaagccgcctccgacagcacggctcgcgagagtgcccatggcggacccgctcgtacgggggcgcggaccgcttacggggcagcgggcgcagcacggcctggtcctcggtgtcgcgcgggtgactggatggcgtacacatctccgatacggtcgtcgccgcgccgacgctgtcgccattcttcgtgagcccggaacaccatgacggacacctgtgaagcaggctgccagtgccgtgtgaaggtcggagcattcacgtccggggcgtcttccaggggtgcaccgtgcttccccagcagccgctccagtttgtcgaaccggaggtggcggtcgaagcgcccgtaccggtcgcgaattgccctgttgacgatgctgccgcccgagtacgacagccggtgcacctgcaaggtgaagtggtgcccctcccaaggatggtccggtgtttcccgaatccagaagaactcagccattccgtagtcgcgccacatgctgtggtcgtcaagggagttctcggcgaaatcggaacccagcatcgcggtcacccggtcgggactgtccgtcggatgggcaccgagcaccgttccggaggcgaccacgtccatgtagaacgcaagggaatgcggagtcaactggccttccttgacggggcgccgggtatcagaagcgacggcctcagcatatgcgaccggggacgccacgaagatccgccggacaggccctggtcgacaggagcgcttcgctcaccctgccctcacagtcccccctcggcatctcgcgcaccatgcctcatcgcgccaccggcagcacattgcgtcgtaccactcctgccacacccgcccgtctcagtttccgtctcatccagctccgttcacggtcgtccaggcgagacacagtcacaccgcaccgcaccgcaccctgaaccggcggcacgtgctcgccacccgtcccgccgctgctctgatgtcacagacggcggggctgtctcgtctcaggtctcggagacgaacttcgggaacaggaaggtgatggtcatgcgggtgttcgtggcgggcgggaccggggtcctgggacggcggctggtgccgcagctcgtggctcgtggccaccaggtgacggccacgacgacgagcgcagccaaactcggcctggtggagcgcctgggtggcgaggcggtggtgatggacgggctggacgcggtgtccgtcggtgaggcggtggcggccgcccggccggacgtgatcgtgcaccagatgaccggcatttccatggcgcacgccggcaagcccgacctgaagcatttcgaccggtggtccgtccccaccgtccggctgcgcaccgaggggacggaccacctgttggccgcggccgaggcgaccggcgtagcgcacttcgtcgcgcagggatacgccaactggaacggaatccgcgagggcggatgggtgaagaccgaggaggacgcgctggacctgcacgaggggacggctgcgtatacggcgatggcggcgctccgccacgtcgaggacgcggttctcaaggccgacggcgcggtgatgcgttacggcgcgttctacggaccgggcgccaccgacgaccagctcgtgctcgtgcgcaagcggcagttcccgctggtcggggacggcaccggctacgcctcgtgggtgcatctcgacgacgcggcgagcgccacggtcctggccgtggagcagaagacgagaggggtgttcaacatcgtcgacgacgaaccggccccggagagcgaatggctgccctggctggcggcgtgcgcgggggcgaagccgccgatgcgggtccccaggtggctggcccggctgctggccggagatgtggtggtgacgatgatgaccgagggccgcggcttctccaacgccaaggccaagcgggagctcggctgggagctgcgctatccgtcgtggcgacagggcttcaaggaagggctgtcgtgacccggaccgaggagttcgaagagctgcggccgctgctgttctccgtcgcctaccggatcctgggcagcgtgagcgaggccgaggacgcggtccaggagacctggctgcgctacgagctctccccggccaggcccgcgtcagccagggcgttcctgtcggccgtggtcacccgggtctccatcgacgtgctgcgctcggcccgcatgcggcgggaggagtacgtcgggccgtggttccccgagccactgctcaccgacccctacgaggacccggagcagtcggcggagctggccgactcgctgtcgatggcggccctgttgctgctggagcggctcagcccgctcgagcgggcggtcttcgtgctgcgggaggtgttcgccttcggcttcccggagatcgcctcggcggtgggcaggtcggaggcggcgtgccgccagctcgcggtgcgggcgcgccgccacatggacgcgggccggccccggttcgaggccgaccgcaaggagcgcgaggagctcgccgagcggttcttcgaggccttgcgggaggggaacgtcgacgggctgcgggaactcctcgccgccgacgtgtcgctggtcggggacggcggcggcaaggccccgcagtgggccaggggcttcttcggcgtcggccaggtgtcccagatgctggccaccctcttcccgccgttcttccggatcggcggcgtcgtggacccgcaccaggtgaacggtcagccgggcgcgctcttccgcgaccgggacggcaaggtcctcaacacctggacactcgacatcctcggcgggcagatccaggcgatccgcacggtgagcaaccccgacaagctcgggcacctgggccccgtggcggacgcgtgggcggtcctgcgcgaaacgcagcaggtccgtccggacccggagtgacccgaagagctcactgcgctgcggacccgtggtgccgggtgcggcaggcgggccggaaaacccctcggggaagcagcggcggcgacggcttgccgcgccccgacaagaaaccaagcagccacaggttcagcgcaccagaaccagaacaggagaatcggacatgatcaggatcggcatcatcatcggcagcacccgccccggccggaacggcgaccgggtggcccaatgggtgcgggatctggcggctgaacacgcgggcgacgccgcggacttcgagctcgtggacctgaaggaccacgcgctgccgctgctcgacgagcccgtgccggcggccatggcgccgggccggcagccgcacacccggcgatgggccgagcggatcggctcgtgcgacgccttcatcgtcgtcacacccgagtacaacaccgccccgcccgccgccctgaccaatgccatcgactacctctacgaagagtggggcggcaaggcggtcgcttacgtcggctacggcatcttcggcgcggtcatggccgtacagaagctgcgcgcgcaggcgggcccgttgcgaatggcggacatcgggcctcaggtggcgctgtcgctacgcgaggacttcgtggcctttgccgacttccagccgcaggaactgcatgtcgcggaggtacacgggctggtcgacgagctgctggcgtgggcgaaggcgctcggcccgctgcgcgcggcatccccggctgctgcctgaacggcgaaaagcccatcccctacaagtcgaagccgctgtgcgaacggtggcggtccgtgccccggccccgcgccggggtacggaccggcctgtcggtccgatcaccgaacccgctgcctactgcaccggcagcaggacctgatctccatcgtcaccgacctccctcgaccgacctccctcaatcgaggcggcggcttcgggtccctgcgcaagtcgctggacaccaccatcccccagcaaggagctggccgtgatcgaacacgccacacaccagaagatcgcgctgatcaccggggcgaacaaggggatcggccgggcggctgccgagcaactcgccgcgctgggcatgacggtcctgatcggcgcccgagacccacggcgtggcgaggaagccgctgcggcgttgcgcgcggcaggcggcaacgcgcaccaggtcaccttggacgtcaccgaccaggccaccgcccgggcggccgcacagcagatcgacgagcgcttcggccacctcgacgtgctgatcaacaacgccggcatcaccggctccggacaggtctcacccgaagacgcccacgatcaagtccccagctccgtgaacctggacatggtccgggcggtgttcgagaccaacgtcttcggggtgatcgcggtgaccaacgccatgctcccgctgctgcggcggtcaccggcgccgcggatcgtcaacgtcagcagcgccgccgggtcgctgaccatcgccagtgacccggacggcccgctcacggggctgccgacgtcggccgcgtacacgccctccaagaccgcgctgaacgcgctgaccgtgcaatacgccaacgaactgcggaagaacggctttctcgtcaacgccgccgaccccggctacgtcgacacggagatcaacaaccacagcgggtaccttacggtcgcgcagggcgccgcggccctggtgcgcctggccacgctcggcgcggacgggccgaccggcgggttcttcagtgaggacggcccggtgccctggtgacggtgcccctggacagcggcgactaccagtccggccaggccggtaaacaaggccagatcaatctcaccgggatttcccgtaccgcaactactcacacccggtgaggccagccggttcacggcaactgaaggccattcagcgtgacggccgcccggcgaccgcaaccagcggccgcgcaagcggcactggagccggtcagcgggcacgggtcggcgatgattggcgaagtagacatcatcctcggcacttcgtgagccagttggtgatggccatgctgtcttcggcgacagcacgctgctcctggtgcctgaacgcgcgtcaccacggtgcgctccggggcaagacgcaggcgctcgccgcggcttcgaaacgaagtgaccgctacgggtatctctaccggtagttgagctcggcgagttcggtggcgagtttcttgggcaggcccgtgtggccgagcaggggaagcacgatgttgcgggcgccgcgggcgatggcgctgtgggtggtggcgatgcgggtcatccggtcggtgaaggcgaccacccgctgggcgaccgggcggcgccgggcctcgtagccgtcgagctgcccggtggcgaacgcccggcccagggcgtggccgtcctggataccggtgttcatcccctgaccaccggcggggctgtgcacatgcgcggcgtctccggccagcagcacacggcctacccggtagtggtcggcgacccggtggtgcacccggaaacgtgaggaccaggcaaggcccgtgaccttggcctggccgggggcgcgctcgtccaacagctgctggacgaaggcgaggtcgggggtgtccggagcgtcgtccacggtggcgacgacccggtagtggccgccggggagcggggcgacgacggtgagacccgcggtgccgaaggtgagcgacacctcgctggggcccggagcccagtccatcacgacatcggcgagcacgaaggactcgctgtaggcactaccggtgaacccgatgcccgacgcttcacgcacagtgctgtgcatgccgtcggtgccgacggcgtacccggcgcgcagcgtctgcccggtgctcatggtgagcgtcacaccgtcctcgtcctggacgaccgaagtgacctcgtgcgggcggtgcacatcaccgccgagcgcccgcagccgggccagcagcacactctcggtctcgtactggggaaccatcagcgtgtacgggtgggctgtgggcagcttgtcgaacggcacggtcagcagccggcgggagccgtcacggacggcgaaccgggtgacctggatgccgcgcgcgatcagctcctcggaggctcccagctcgtccaggacctccagggtgcgggcatgcacaacggcggcacgcgaggtgttcgcgccctccgccagccggtccagaacgacgaagtcgatgccggaggcggcgagcgtgacggcgagcgcaaggcccgcggggccggcgccgacgatggcgacctcggtgcgggcggggagtggggtggtgtccatggcggagtcttccgttcacatccagacggaaagccaacaagcgttggcctacgttcgttgacagagtgcccggctcgacattggaaagtcaaccgctgttggcctacgattgttggcatgacgtcgggtactgagatcaccagcacagacaagcgttccgaccggaccagggccgcgatcctgcgcgccgcacgtgagcgattcgccgcccagggctacgaacgcaccaccatccgcgccgtagccgccgacgccgacatcgacccctcgatggtcatgcgctacttcggcaacaaggcacagctcttcgacatggcgctggccatcgacctgcgactgccggacctcaccgccgtcgcgccggacgagctggcacgggcgctggtgcggcacttcctcgaccgctgggagggcgacccggccgacgacgcgctgctggtcctgctgcgctcggcggtcaccaatgaacatgccgcggcccggatgcacgagatcttcgcgacccagatcgccccgtcactggcctccgccctgggccccgagctcgccgcacgccgggccggcctgatctcctcccagctcctcggcctcgggctgacccgctacctgctgcgccttcctgcggtgaccgcactcacacgggacgagatcgaagacggcctcgcgccggccatcaaggccactcttgagtcgagctaggtcaaagtcaccgtggtgggcggcgaccagacatacccaccggccgcccggctcacaggtcgggacgcgtcagcgccatcgccgccctcatcgccgtgcccatcgtcagaagagcgtcatgaatcgtgccccggacatcaggtagccgccaacagcgcggtccgctgccgccccgggcacttcgatgggactcggatatccgtgtggttgcgcaccgaggggtgatcgagcgatgggcgatgtcgaggggcggcgcatcgttgccggagtaagtggttcgctgggcagcctggcggccttgcaccgggccgcccacgaggcccgtcgtagccgcgccgagctgctggccgtactggcctgggaaccgcctggcggtgatctcgcccaccggcgatcgctgctcgcgtcgccggcgaccgactttcggcaggaggcgggcgagcgactgctcgccgctctccgcacggccttcggcgacgcggggcctggggttccgttccagggcctggtcgcacggggcactccagggcgcgcactggtggagaccgcggaccgggccgacgacctcctcgtggtcggcgcggggtaccgcgggaggatgcaccgtgctctgttcccgtcggtcgcccggtactgcgtcgcccacgccgcctgtccggtcctggccgtaccgccctcacccctacagggcgagctcgcctccgtgcaccgccgcatcagccttcgactgccgctcgatgcccgggaattgacggacggcaggccctgaccgggcgtgccggaccggtggtgtcccagaaccgcgccgggcacggtgtcgggccgcggcgcctcaagggtcctcttgacgatgtcgtgcggtcgaacacacagccaactccgtgccgtgtcagggtcgcgttacgggtccggcgcttcgcgtcaaacatccgtcagtgaaggggcccgtccccggaccggcgggcatagcttcactggagcgccccggtcagtccgaccgagcggcgcacacagccttcttcgaggagcagcacgatgtctccagtcgagtattccgaggaccccgagccctctgaacgcttcccggccggacttctccacgtccctgtccggtcggggcccgcgggctgtacggcccggttcttccgcacccccctgggcggccgtacggccgtcggtttcacctcggcggcgaagctcaccgccacgctgggcacggaccaggcctgcatcaggctttccgagcccgcgctgcgcgcactcgccgcacccctgggtgtcacggccctcaccgtcgacccgcccttctccgcccccgcggccgaccgcaccgcggccacaatccgtgagcacgagaattcctggcgacgcctgcatccccggcgcgtcggtgccctgcgggtgactggtgccgctgccgtcgtcgcgtgcctgaacctgctgatcggctgaggagacgccatgtcagtttctgttccgtcgtcccttccgtccgcgcttccgccgtcggtcccggccttgccgccctcggatccccagaccctgtcccggctcctcggcgacaccgacggcctgtccgtctggccccgctccgcacgccccgaagccgacggcgacgtctgtgtcggcggtgtctccctcaccgaggcggccgaccgcttcggcacccccgtgtacgtgctcgacgagcaggaggtacgggaacgctgccgtacgtaccgcacggcgttccccgaagccgacgtcgtctacgcggccaaggcgttcctgtgccgtgcgatggcgcactgggtgcaggaggagggcctcggcctggacgtctgctccgccggggagctggcgctcgccgtcaccaccggcttcccgccggagaagatcgtgatgcacggcaatgccaagagccccgaggacctgcgcaccgccctgcggctcggtgtcggacgcatcgtcgtggacagcgcctcggagatcgcgcgccttgccgcgatcacaccctgcgacacccgccagaaggtcatggtgcgggtggtgcccggcatcgcggccggcggacacaccaagatacgcaccggcaccgacgaccagaacttcggcctgtccctcacggacggatccgcgcagcacgccatcacccggatactggaccagccgcacctcgaactcgtcggcctgcactgccacatcggctcgcagatcgccgccgtgaagccgtacgtcgccgccgtgcggcgcatggtcggactgatggcccgggtaagggaccagcacggggtcatcctgccgcagctgaacatcggcggcgggcacgccatcgcctaccggcccggcgacgagaccatgaacgtgggcgtgctggccggccgggtccgcgccgagctggaggacggctgcgcacgggcccgacttcccgtgccgcggctcaccatcgaacccggccgggcggtcgtcggccccgcgggcgtcgccgtctaccgtgtcctcgcggtcaagcgcaccggcgagcacaccttcgtcgccgtcgacggcggcatgagcgacaacccgaggcccgcgctgtacggagtgcggtacgcgccccggctcatcggccgcccctcctccgccccgtcccgtttcgtcactgtcgtgggccggcactgcgaggcgggcgacgtcctcgccgacggggtggcgctcccgggcgacgtacgccccggggacctgctcgcggtgcccgcggccggggcctaccacctgtccatgacctccggttacaacctggtcggccggcctccggtcgtcgcggtgtccgacggcatcgcgcgcgttctcgtacggcgtgaatcgctggacgacatgagccgtcgggacgtcggcctgtagcaccgagctcccaccgcccggcccccaccacccggcctccgccgaagctccccctcgtcggaggccgctccacgcatgccgccggcagcccgaacgatccacggtcacgcgccgcgcggggccacacggtcacagctgatcagcacggccgacccgatcggcaccagcccgagcagcgcacccggcatcggctcagttcgccgcgcccgtttcacgcgcggctctcggaaggcgggcacgccgttggcgatggcctccacaccggtcaacgccgagcagccggaggagcacgtgggccgcgtcggccttctcggagttgcagatgttggcgtgcgccatcctccggcgcagggccggcggacacgggtccagccgcgcagggccttgatgacgtccgtgccgtccatgtcgggcagcccaggtcgaggacgaccacttcgggccggcgcgcggcggcacggcggagcgcggtggcgccgtcgggggccgcgtccgctccgtaccggcgggcccgcaggttgatcacgagggcccggacgaactgtggaccgtcctccaccaccaggacccgggtcatcggtgtgctcccttcctgttgcgcggagggctggagcctgccggaaccggcgtcactgccggaaccggcgtcatggcggcgggagttgacgcatcgggatgtctcccgatgcgtcaactcccgcgtggagcgcgtaaggccgtcagctcgtcgccacgagttccttgagcgcgatgttgagttcgaggacgttgacgcggggctcaccgatgaagccgagggtacggccgtcggtgtgctcgtcgaccagtttctgcaccggggcgacggccaggtggttctgctccgcgatccggtgcacctgaaggtccgcgtactcgggggagatgtccgggtccaggccggagccggacgacgtcaccgcgtcggcggggacgtcggacggcttgaccttgtggtcggcggtcgagttgtccttgacgaccgcggccttggcgtccttgacccacttgatcagatcggcgttgtcaccggaacggttggtcgcaccggacaggatcagcgagtactgggtgttgacgctgttggtgcccagcccgttcgccggacgcccctggaaccacttcaggtcgggctccggggtctcctggcccttcttcagcggcaagttgtacgcctggccgatcagcgaggagccgacgaccttgccgtccgccttgatctccgagccgttcgcctggtccgagaacaggccctgggcgacaccggtgacggcgagcggatagaggacgcctgtcaccacggtgagcaccaggagggatcgcaggccggcccagagcaaccgggccgtgttcgtaaccgagttgttcattgtgatcagcacgctttcaaaaaattacagcccggggatgagggagatgagcaggtcgatgatcttgatgccgatgaagggcgcgacgaggccgccgagaccgtagatcccgaggttgcggcggagcatcctgtccgcgctcaccggccggtaccgcacaccccgcagcgcgagcggcaccagtgcgatgatgatcagcgcgttgaagatgaccgcggacaggatcgcggagtccggcgaggacagctgcatgatgttcagcttgtccaggcccggatagaccaccgcgaatagcgccgggatgatcgcgaagtacttcgccacgtcattggcgatcgagaacgtcgtcagcgcgccacgggtgatcagcaactgcttgccgatctccacgatctcgatgagcttggtggggttggagtccaggtccaccatgttcccggcctccttggcggccgaggtaccggtgttcatggccacacccacgtcggcctgggccagcgccggcgcgtcgttcgtgccgtcgccggtcatcgcgacgagcttgccgcccgactgctcccgtttgatgagcgccatcttgtcctcgggagtcgcctccgcgaggaagtcgtcgacgccggcctcctcagcgatcgccttggccgtcagcgggttgtcacccgtgatcatgacggtcttgatgcccatgcggcgcagctcgtcgaaccgctcgcgcatgccctccttgaccacgtccttgaggtggatgacgccgaggatccgcgcaccgtcggcgtcctcgacggccacgagcagcggcgtaccgcccgcctcggagatccggttggccagcgtgtcggcgtcctcggacacctccccgccctgttcccgcacccaggcgatgaccgacccggccgcgcccttgcggatcttgcgcccgtcgatgtccacacccgacatccgggtctgggcggtgaaggcgatccactcggcgccggagagctcgccctggtggcgctcgcgcagcccgtacgtctccttcgccagtacgacgatggagcggccctcgggcgtctcgtcggccagcgaggagagctgggcggcgtccgcgacctcggcctcggtggtgccggtcaccggtacgaactcggaggcctggcggttgccgagggtgatggttccggtcttgtcgaggagcagggtcgacacgtcgcccgccgcctcgaccgccctgccggacatggccaggacgttgcgctgcaccagccggtccatgcccgcgataccgatcgcggagagcagggcgccgatcgtcgtcgggatcaggcagaccagcagggccaccagcacgaccatcgtgaggtgcgtacccgcgtagtcggcgaacgggggcagcgtggccaccgcgagcaggaagacgatcgtgagggacgcgagaaggatgttcagagcgatctcgttgggcgtcttctgccgtgcggcgccctcgaccagggcgatcatccggtcgatgaatgtctcgccgggctttgtcgtgatcttgatgacgatgcggtcggagaggaccttcgtaccgccggtgacggccgagcggtcgccgccggactcgcggatcaccggggccgactcgccggtgatcgccgactcgtccacggacgccacgccctcgacgacgtcaccgtcgccggggatgatgtcgcccgcctcgcacacgaccaggtcaccgacgcgcagctcggtgccggggaccacggtcccgtcggccctgcgcgccacggtgtccgtcttcgccctgcgcagggtgtccgcctgcgccttgcctcggccctcggcgaccgcctccgccaggttggcgaagatcacggtcagccacagccaggcgctgatcgcccagccgaaccagtcgcccgggtccttgaaggagaacaccgtcgtcaggaccgaaccgaccaacaccacgaacatcacgggtgacttgaccatcacccgcgggtcgagcttgcggaaggcgtccggcagcgacttgagcagttgcttggggtcgaagagccccgcgccgacacgtccttcgtccttgtggccggtcggcacatcgctgtgcggtgcccgggtcggagtggctgtggacatcgagtcctcgtcgttttctgtacgggtcttctccgtacgggtctcttctgtacgggtcttctctgcacgggtcttctctgtgcgagtggtcatgacgccagcccctcggccaacgggcccagcgccagggccgggaagtaggtcagcccggtgatgatcaggatggcgcccaccagcaggcccgtgaacagcggcttttcggtacgcagggtgcccacggtcgccgggatgggcttctgctcggcgagcgaaccggccagggccagcacgaacaccatcggcacgaagcggccgagcagcatcacgatgccgatggtggtgttgaaccactgcgtgtccgcgttcagacccgcgaacgccgagccgttgttgttggcgcccgacgtgtaggcgtacaggatctcggagaagccgtgcgcgcccgagttcgtcatcgagtggcccggggtgggcagcgccatcgccgcggccgtgaagaccagcgccagcgccggggtgatcaggatgtagcaggccgcgaacttgatctcacgggtgccgatcttcttgcccaggtattcaggcgtacggcccaccatgagccccgcgatgaacaccgcgatgacggccatgatcaggatgccgtagaggccggagccggtacccccgggtgcgatctcgccgagctgcatgctcagcagggtgatgccgccgcccaggccggtgaacgaggagtggaaggaatccaccgcaccggtcgaggtcagcgtggtcgccaccgcgaagatcgacgagccgccgacgccgaagcgggtctccttgccctccatcgcaccgccggcgatctggaacgccgggccgtgatgggcgaactcggtccacatcatcagcgccgtgaagccgatccagatggtgaccatcgtggcgaggatcgcgtagccctggcgcagcgagccgaccatccggccgaaggtccgcgtcagcgcgaacgggatcagcaggatcaggaagatctcgaagaggttcgagaacgggcccgggttctcgaaggggtgcgcgctgttggcgttgaagtaaccgccgccgttcgtgccggcctccttgatggcctcctgcgacgcgaccgcgccgccgttccactgctgcgagccgcccatgaactggccgacggagtggatcccggagaagttctggatcgcgccgcacgcgaccaggacgatcgcggcgatcaccgagacgggcagcaggacgcggacggtgccgcgcaccaggtcggaccagaagttgccgagctcaccggtgcgggagcgggaaaagccgcgcaccagcgcgacggccaccgcgatgccgaccgaggcggagacgaagttctgcaccgccaggccgccggtctgcacgacatggcccatggcctgctcgccgtagtacgactgccagttggtgttcgtcacgaaggacgcggcggtgttgaacgcctggtccgggtcgatggaccggaacccgagcgagccgggcagcgaaccctggacacgctgaagcacgtacaggaagagcacgctgacggcggagaaggcgaggacgccgcgcaggtacgcgggccagcgcatctgcgtgtccgggtcggcgccgatgcccttgtagatccacttctcgacgcgcaggtgcttgtcggaggagtagaccttggccatgtagtcgccgaggggacggtaggcgagtgccagtgccgctatgagagcgaccagctggagcacgccggcgaggacgggactcatatcgcttctcagaacctctccgggaagatcagggcgagaacgagatagcccagcagggtgacggccacgatcaggccgacgacgttttcggcggtcacagcttcgtcacccccttggcgacgagggccaccagcgcgaacaccgcgatcgtggtgacaacgaaggccaggtcggccatcgcgagctcctagatgaggttcggattgaacggacgattagaggaaaccgcctctctggccggattcgatcgccgttgacggctctcatacgggggtgcgtacgcctttgacggatctcttacggcgggctgatccatctgcggggcccgtctggattccgtcgggatcccatcccctcattccgcgcgccagtgccggaccatgccgacctgggcgatcgtgaagccgatgaagacaccgatggcgaagagcggcacgagggtgttggtgtcgccgccggagaagacgagcagcgcggcgacgaccccggccagtgtgagcacgccgtgccggtggacctggcggtcggctttcagcgcgaagacgtgcggcaggtagttgtcgcgggccggcagcttcagcagaaccggaagaccgccgaaggaggtgttggccgacagcgccagcaggatcatcgtcgcgaactgaacgacgtagaacgcccagttgtggccgagcgaggcgtccgcgagctgcgcgaggaccgtgacgccctcgacgggctggagatggaagcgcgagatcagcaccgacaggccgatcagcatcacaccgagtacggcaccgagggcgacctccgcgtgctgggcccggcgtacgcgcgggacgcggaaggcaggcacggcgttggccgagggcctcgacgccggtgagcacgctgcatccggaggcgaaggccaacgtggctccggagagcttcggcggatacgccctgaccggcggcgccccggatcacgtgggcgttggtgccgctgatgccgaaggaccccgtccccgagcccgagatgcgcgagtggatcgacggcaaaaggcccggtcggaggttcccaccccgcgacgacccgctctccaggccgtcggccgagcgccgcaggcccacgatggcctgcggcgtcccgtccagcacggcggggtgcaacacgctcccggtcagcgggtcggcagccgtagctcggccggcgcctggggacgcccggccgcgtcggtgcccgtgcgcagaccggtcagcgagcgttgcgcgggacggtagtccagaacgccgcgtgccgccgggcggtcacgactccacttggtccgcgcgggatccggtgccgcgcggtgtggtgtcggcgatcactgcggtgggcgggtgtgcggcggtggccgctcgggtgtccgggtagaacgcgaagacctggtcgaggcccacgatgcccaggacccgggcggtgttggccgggaccgcggccaggactgtgtcgacgcctgcctcgatggccaggttgcgcgctgccaacagcagcgtgatgccgctggagtcgcagaaccgcagacctgccaggtccaggaccagcagctggccgcgggccagggtcaggcggtcgatcgcgtgacgcagttccggggatgtctcgtggtcgaggtcgccggtgatctccagtacgggaccggtaggggcgtctcgggtggtgatcgtcagcgggctcatgtcagtcatctactcgcaggggctggtcgggcagggaagcgggcacgccgaaggccagcagggcggtgtcgtcgtcgaggccctcaccgaagccggcgagcaggccggtcagggcggtgatcagggcctgtgggcccgcaggcgtccgggcggcggtgaaggcgcgcagggcgtcgtcgccgtacagctcacgccgcggcccgatcctggcctcggtcaggccgtcggtgtagagcagcagcgtgtccccgggcagcagcaccgtgcgggcggctgtgaactgcgcccggggcaggacaccgatgagcatcccaccgggggtggggaggtagtcggcgtaggcgtcggcgcgctggaccagtgccggggggtggccgccggaggccaggtggacggcgcagccgtcgctctggggttccaggaagccgaatacggcggtgcagtagcggggctcgctgccggtgtaccgctcgtgcaggaccgtgttgagcgtggccagtacgttgacggggtcgggctcgtgcaaggcggcggcgcgcagggtgtagcgggtcagcgaggtgacggcggcggctttggggcctttgccgcacacgtcgccgaggaagaatgcccacctggtgccgtccagcgggaacaggtcgtagaagtcgccgccgatcaggtccggggaggcggtgtggtagtgcgaggccacttccaggccgggaaccgtcggcagggtggagggcagcaggctctgctggaggacggcgagtgcttcctggaggcgctcgcggtcggcctcggcctgcctgcgggcgcgcagcagttcggtctcgtacgcgcggcggtcgcgggcgtcgaagacggtgctgcgtaccagcatcggctcaccgtcgtggctggtcttgaccttcgaggtcaccagcaccggcagccgctgcccgtcggccgctttgaggtccagggcgatgccgttgacctcgcccttcatttgcagcagcggcgcgaagtgcgtctcgtggtagagcttgccgcccacggtgagcaggtcggtgaaccgcatccggcccaccacgtcccggcgcgacaggcccagccagtccagcagcgtggtgttgatcttcgcgatggtgccgtccatcagcgtggacaggtaaccgcacggcgcctgctcgtacagttcctcggcactgtcctccagcagcgacgtgaacaccgtgtcggtggcgtcggcgtcctgctctacgtcccggtcgcggcacatcaccgtgttgcgccgaggaaggcggtgatggcctgtgccgtggcgtcgggtgcgctcagctgcgggcagtgccctgtcgcgtccaacgtcaccaggcggctgccggggatcgcggcatggacgtaggcgcccacctcgcgcggcgcgatgacgtcctgtgcacactccagcaccagcgtcggcaccgccaccgacttcaggtcctggcggctgtcggacaggaacgtggtgcgtgcgaaggcccgcgcgatgtccggatcggtcgcgcagaacgaggcggtcagctcctcccccagctccggccggtcgggattgtccatgatcaccggggccatcgtcgccgaccagcccagatagttcgaatccagggacgtcagcagctcgtcgatgtcctcggcgctgaacccgccccggtacccgtcctcgtcgatgtaccgcggggagggagcgaccatgaccaggcgggagaaccgctccggcgccttctgcgccgcgagcaccccgaccatcgcgctgaccgaatgccccacgaaggccacatcccgcaggtccagctcctcgcagacctccagcacatccagggcgtagccctccagtgaggagtaacgctgctcgctccacgccgacagatccgagcggcccgaccccacgtagtcgaacagcaccacccggaagtcgtcggccagcgcgggaacaaccagccgccacatgttctggtcacagccgaacccgtgcgcgagcagcaccaccggcccgtccgggcggccggtgacgacgacgttgttcctccggcgtatatccatacccgccagtgtcccaccacccccaggcgcctcagccggggtcttcgtcccgcccctgccctgccgtgcccgaggcggcagcacgtcgaaacgttgccggagtcggtgggctgcgcgaacggggccgtgcaagagggccgcgcctggcagaaccggtgccctgaatccaacctcttcggtcacgccgactcttcggtcacgcggagcggagcagcggtgtcggaggggccgaaaggaccttcgcccggctccgcccgatcgtcgtctcgtcggcgagcgccctggacatccggcgggcggcgcctcgtgggaggcacggtgcccgcgcaaggccgtgcggcggcgtgagactgtggtgctatggaacaggccccccgaggggatccacaccatggcgacacagagcacggcgcacgaatacctggatgagccgttcgacatcacccatgcggctgtggtccgcatcgacgcgcacggtctgatcgagggatggagcaagggcgcacagacgctcctcggctaccgggcaagcgagattctgggacggcctgccgcctcgctgctgaccggcgaggcagacctcgcttccgccatgtcggagccacgccgtacaggcaacggctgggaaggcctgatcgccgtcaggcatcgctccggccaccacgtggagctggcactgcgcgcctgcccgttccaggacgatggtgggcgccgaagctggcttgccgtggtcaccccggtgagcgcgccccgcaggtgggcactggagcaggcggtgctgcacggcctgctcgaccagtcgcccatagggatagccgtggtggacaccgacctgcggtaccagatggtcaaccgcgtactggaagacatggacggcgtgcccgtccagctgcgcatcggccgcagagtcggggaggccgtgcccggggaagccgactccaccctcgagtggcaggcccggcaggcgctgggcagcgggcagacgctgctgatgttccagcatgccgtcccggaaccgggcgagccctaccgacaggaccgtgagcgcgtcaggctctgcgcgtccttccggttgcaggaccgtacaggccacctcctgggcgtgtgccacaccacggtggacgtcaccgaccatgaccgggcccgccagcgactcgccctggtgaacgaggcgagcagccgtatcggcaccaccttggacctggaccgcaccgtgcgcgagctggccgagatcgtggtgccccaggtcgccgacttcgtcgcggtcgacctgctggacacggttctggcagcccgcgacctcacgcccgtcgcggtggacggcgagacagcgctgcgccgagcggcgcacctctcgatccaggaagatcaccccgaggtcgtggtcgcagccggggaacccacccgctacccgccgacctccccgcagagccgatgcctggctaccggtcgctcgatccgccacccggtcatcgacgggtcgacgccgtggctggcccaggacccgctgcgcaaggcaaaactggacctcctgggcgtgcactcccacctggtcgtccccctccaggcccgaggcatgaccatgggcgtggccacgttgctgcgctggaagcacgcagagcccttcgacgacgacgaccagcttcttgtcgaagaactggcagcccgcgcggccgtctgcatcgagaacgccagacgtttcgcccgcgaacacaacaccgcactcgccctccagcacagcctgctcccccacgggctgcccgaacagagcgcggtcgaggcggcctaccgctaccttcccaccgacaccgaagccggggtcggcggagactggttcgacgtcattccgctgtccggcgcacgggtcgccctggtcgtcggggacgtcgtcggacacggcatccacgccgcggccaccatgggccggctgcgcaccgccgtgcagacactcgccgacctcgacctgccccccgacgaactcctggcccgcctcgacgacctggtgatccggctcgcggacgaagccgatgccgccgccggcggcgccctggtgatcggcgggacctgcgtctatggcatctacgaccccatctcacgcaaactcgtcgtggcacgggccggacatcccagccccgccatagcgcacctccgtgaaccagtggaattccctgacatacctgccggcccacccctcggactgggcggcctgcccttcgaatccgccgagatcgacgtcgaggaaggaagcgtgatcgccttctacaccgatggcctcatcgaagcctccgaccgcgacgtggacgtcggcttcgaacggctctgcttcgcactggcccaccccgaccgcccactcgacgaaatctgcgacacgatggtccggatgctgctgcccgagcacccacacgacgacgtcgccttcctcgtcgcccgaacccgtgcactcggcgccgacaacgtcgcctcctgggacatacccgccgtcccctcggcggtccacaccatccgacagatgaccaaccggcaactgagcgcctgggatctcgacgatgccgcattcaccaccgaactcatcgtcagcgaactcgtcaccaatgccatcaggcacgcctccccgcccctcagcctccgtctgatccgagaacgcgccctcatctgcgaggtgtccgacagcagcaacacctcaccacacctacgccgccccctcggcaccgacgaaggcggacgcggactcttcctcgtcgcccaggtcgcccaacggtggggaacccgctacacccctcaaggcaagaccatctgggcagaacaaccactaccctcataggccttggccgccacctgcccgtccggtaaggacgcgttgccgagcggcccggacacgctcgtgccgcgttggcggagtgccactcggcccggccgaagccctagcccgccaccttggcacccacggggcgcaagctcactgggcggttcaaactcccgtatttgtacgcctactgacgtatgtatctccatattgatcaccctaaaaatagaggggctcagcggtcgcacggcacactccgtagccttccgaagggtcgtgtatggcgctccctcgttcgccggccgctgccctgcccggtccgcagtgggccgaacaggacagctggtcctaccgggatctcgaccaggctccgctgtcggccgagtgccgtgacgaactcgaaacgctgcgggccgaggcgggcggcggccggccgccgggcggctggccggccgggtggcccgcaccgccgctggtcgtgcgggagtcccttttcctctgcctgttccgcgcggcgctggcccggggggagctgcggtacgggcggttcgtgtggcaggacctggacagcgagttgggcgtccattaccaggagagtcgcgcggctctgctcaacggcatcgtcctgatcggactgcgtaccttctgcgaccagatctccggtggcgaggcggcgcagatggagcttgtggtgccgatggccgtggggactccgaacgagccggccggactggtcgtggcggccgagacgaccgctcgcgggcccgagctgctcgtggacgtctggggcgagacggccgtggcggcctgctggcaggccctgatcgcggtgtgccgctacgtcgcttcgctggccggtgaggaccagtactgccggccgctcgtacccgggggcgtccacgccgccgacggattcctcaccgtggtgcctcaggccatgcacgccgtcgaccgtcaggggccgcgatgaccctcccgaccctgcctccggagctggtccaactcgccgtcgcgctcggggttctcaggcgggagccgggggacggcgcggatccccggctggaggtggatcaggccttcttcgcggatcccggcaagcagttgtccggtgtgctcagcgatccggtacggcgtgcggccgcgctggagctcgccgcggcgctgctgggcagcgcgaagaacgcggccctcgaaacggagggcgcccagcccggccggacctggatcccgctgcccacgggcgacggtgccacggccggacgtctctatctggtggtggacgcgtccggcgacacggtggcgctgtcgctggccggccgcgccacgctgcgggccgccgaggtggagtgcgccgcctcggtcgtcgtaccgatggtggcgaccggccccggcggtacgcgattcctgcccggtaccgcggacggtgacatccgcgtcgccgtcagcctgcgactccccccggcacccggcgacttcggcctgggcggcctgcgcgtcggggcggacgtccccacccatgccctcggccgcccccggctgcggctgagcctgaccgggctgcggctcccgggcgaacccgcccgcgatctggacatcgacgacgggtcactccccggccggctgggtgagctgatcccgctgctcgccgacctgctcaccggcctgctccggtcgagggggacgatcgatcccgccagtgccgggcggctgcggctgctgctcacgctgttcgggctcggcgacacctccgtcattccgccgcttccgctggccgaactcccgggctccggccccctggtgttcgccgactggctgcgcgcggtgttccttcccaagcccggcgaaccggtgccgccacccgcggcacgggcgtggctggagaccctcgggcagctgctcgggctccggctgtcgctccccctgcggggcgaggggaccacggcttcgccgtatctgctctgcctgagcccactgcccggggtacgggtctgtgtacggctcgtcgcccaggcggcggacgacgggctggagctcaggctgggcctgtcggccgcggccgaggtgtccggggcggtctccgcccatgccgcggccgatctgctggccctgcgactgggcggcggggccgatgtgctgtggctgcccgaggtacgcgtacatgtcgaggtgtccggcgccgagggacacctgctgcgccgcccggccccgccgcagccggtcaccttgatggtggggacgctgtccgccggcttctcgatcggctcggaccgtgcggtgcggctcctgctggaggcggccgacgtcgtcctcgacggacatccgtactcacgtctggacctgtccagcgtcgaggcgctggccgcggccgccgcgcaggtgggcgtcgacgccctgcacgatgcgctggagacactgttctcaaacgacgaggacggcggcggacggcgtgccacggccctgctcgtcctgctggccctgcgcaaaccggccctcgactggccggtcggcctgccgcccctcaccgagatcgtcggcaaccctgcgtacgcgctgctgcgttaccactcccgggtcctcgccgacgccccgcaccgatggggcgccatcgccgcgcagctggccgtcctggtgcgggcccccgccccgaccggcgagggcagcgccgtagacccctgggtcgtctccgtgggcgacgtgggcctgcccgcccggccggccctcctcctgtggcaggacgacgccgaaggcgcaccccggctgaccgtcggagtccggctggtttcggctccgctgcccatcagcggcggggctgtgcggctgtccgccgcgctggacgccgtacggctgactctgcccgctgtggacccgccgtccgccgtcgcgctgaccgccgcggagctgcggctggcgtggggggaggatctgtcgttcgacgccgggcccgtacagctgaaggcgggttcgctcctcctggccgccgggtggcggcagggggccggatggggggcccgcgcgcgggtcaccggtgcttcggtcacggtcgagggcgacgaggtggccctgccggatccgctcgaactcgccacaggggtagacccgttgctcccaggccccggatccgcgctgtggccggcgctcacccgcctcgccggtctcgcgctgctgcgtacgacaccccgcgagggtctcgacccgcggagcctgctcgccgcgctgctcggctggctgccggcgcgtggacggctgcgggtgccgggtgaggaggacaccggcatcgacctcgccgcgctgatcgccgactggccgccactgccgctggcgggccttgtcaccgatcccgtggagacggtccggtcctggctcggcgacgttctggcgggcagtggtggggcggaccgcagtgtggccgccatcgcgttgctgcgtgaacttttcgcccgcggcgggccggagcggatcaggcaggtggcggtcgcgggcgacggaacgcacgagcggccctggcggctgcccctcgacgactcggggcccgagctgctcatatggctcgatcccgacgggcccggtctggacggtctcggcgaggtgctcgacgcgctcgtcccggccgatctcaccgccgctctggacggctcggcgccgctccccggcgtcgagcggctcacggcggtgctcagcggtgccgcgcgcttcgacagcgacctggccgaactcctcgacgagcggccggactcggcagccgatctgtgggcgctgctgaaccatgcagcgggcagcgacgggctgctgcccgtctcggcgcaggtactgccggggaccacgcaccccaccgtcgttctgccgcgcggtcacctctgcgcgccggagacgttcgaactgagcgaccatctgcccggcgcggaccccacccgcacggtgtacgtctccagcgacctgcccgggatacgaccctggcccggtcagccgggggcggccggggcacacctgctcgatctgcggacacccggcctggcggccgagtcgttcggtctcggcgggctggcggcgaccggcccgtggtacgtactgcttccgccgaccgaggaggcaacggtccgtctgcgcccggccgttgccgagttccgacgcctggccggcgcgccggtcgtgctcgtggcgcactcgctggccgcccgggcggcggtccaggtctggtccgaggggggcctcgcgcagctcgtcacgctgggcgggccactgtccgacaccgcccggcccgggcctctcgacggactggaacagccgggcgtacacgatgccttccggctgttgcagtccctggtgggcctgctgcccgcgggcagctccaccgacggctcgccgctggcggaactggtggcgacctgggcggccgtgaccggtgacgctccctcgggcctacgttccgttccgttcccggtctcggcgttcacacccgtcgctctgccgtccgcggcacccgctccggtgctgagcgtcgtcacccagttcacccgcgaagaactgcatggcgcgctcaccgccctggtcgccgcggtggccgcccaggtccgtcgccggctgcccggcggcggggccgtgccgggccgctcccgggccacccacctcggtcttggactgagcttccgcagcacggccgctgccgccgagggcatcgtctgcggcagtgaactgcgcctggacgcatggcgcgtcccgctgcccgccgcgcagcggtcggcgccgacggtcactccccggctccacgtacgactgacactgcggcggcccggcggctggctcctcgacggcaggccgggggccggggcgcggaccgggccgcaaccgcgactgcgcggcgcggatctcctggtcggtatcggcccccgcctcgacgacgcctccgtgtcggccgtgctccatgacgcggcactcgacggagtgggccacggccggctcgcgatcaccccgcacacgctggacgcggcggcccgtcggttcctggggctgctggcggacacgttgtcgccccggccgacggcagggcccgtgcgcgacctggtggacctcctcgtgcaggcgggcgtggccgtcctgacggccgaggagcgcgtggagctccgcccggacaccctggagcgtgtcatcgcggatccggcagggctcatacggactctcctttcggacccggctgtccgtggcacgctgcggcggctggccggactgccggacggcggtgcggggttgctgtccgccggcggactggaggtcggcgtcacccccgactgtgtgatcaccgtcagcacaccggagcggggtctgccgctcgccggcatcgccaccgtgcacggcacgctcgtcgtcggcccggagcgcgccccggccctcaccctcagggtgcgctccggacaggtggaggccgccgtgctgccggagcccgatcttccggctctggcccgattggtcatgctcaccacgggcggcgaggcgatccgctggggtctgcagtccctgcgcgaccgtggcatcctcctcgacccgctgctggatgttctcggcctgctggcgcacgacccgcggcgccccgacgccccgggatcggtccgctcccccgtgcctctgatcaccgcgccggggcgccggctcgtggaggttctcggcgcggaccggcccggcgagcccttcctgctcgcacccggtcacctcgcccggctgatcgacgcggtggcccaactgatcggcttaccgggcgggttgactgcgctgtcgctgcccgggggcggttcggtcagtgtcgccgaggacggcacggacctggaggtcacgctgcggctgcgggacgggtccgggcccgctgcgctggagtccgccgtgcactggcggctgcggcccgggccgaccgtcacggcgtggctgacgttgtccgccgagcagtccgggccgggcgggttcggcgccggtctggagctggaggtcggccccgaggtgaaggtggccgcccggctcacgccgcgggccggcgcgccccggctggacatcccgctgtatccgctgacgccgggactcggcgcgctcgcggagctcggtcagcaagcggcgcagtacgcccttccgatgctcctggacgttttgcgggacctggccgatccggccgatcccggcgatccgcggctcaagcagatcgccgcggcgctcgccgggctgctggccgcgctggagctgaccgatgccgacggcgcggcctcgatcgagcagttgaagctgctggcgtccgctcccgccgacgagttcggtgcgcggttccgccggcatccgtccgaggtgaccgccgcgctgaaggcgctggcgcgcgccctgatcggggacgcggccgcgcagccgcccgtgctctggcgcagccccggtggccgcgtcgtcgtcgacctcgacgcggcgcccgggggcgtgccgcggctcaccgtcaccgcggacggcctgcatcccgttcccggcacggacgccgaggtgtcgttcgccgccaccacggccggacccgccccctgtcacctgtcgtggtccgtcgtcgatccggacgcgctctttcccggcccggtcgacctcatgccgttcgtgcgggtcacgctgggcggcgtcgacgaccgggtggaggcgggcctgtggctcgatccgcccgggacgaccgaccgggaggccctggtcctgcggctgccgggcagtccgacgctcgtgcaccgccgtggagccgccgactccgccgaggtcgcggcggccgtgcccaagctgatccgccgtatcgccgtacccctcgccgccgacctggcactcactccggccccggtcacggacctgctgaaggcgcccgtgggcaacgacagcactgtggggaaggtcctgcactccgcgcggatcctgaccgggaccggcagcccgcccggcgcaccgtggcggctggccgacgggctgctcgacgcgccgactccgcgggtgctgagcgctctggccggcttcctcaccgcgctcgcgccacggctcggaccggtacggctgcaactcctcgaagccgaggacgggccggggcaaaggcggtacgggctcggtctggagctcgtcgagacgccctacccgctcctggagctgggcgatgtcgtcgtcgcgctctcggccgacggttcctgggagccaccggcggccggagcgggcaccgctcacgtagaggtgtggctcggcagcctgccggacaccctgccgggcccggacccggagttctcccccgcgctgcgactgcggggactcgggcttcaagtgggcggcgcgaaaggcccgttgctcgaccagggtctgcggatcgacgcgctgtcgctgcacggctcatacgcacgcgacgcgtccggcttccaacacgccggtgcacggctggagttgcgggggctggccgtgccgttcggctcggccggaggtggcacgaacccggtcgccgcgaagatcctgcaaccggaagccgcgggcggtgacgccactgcggccgcgccgggcttcgatcccgcgctggtcgtgtggaagcagggccaggacccggtggcgctgcggctgagcgcgggcgcggggtccggtccgtggtggctgtccgtggagaagcagctcggtccgctctacctcgaacaggtcggcctctccgtggcctacgacggtgaccggctgcgcgaggtgggtgtgctcgtcgacggcggagtggcgctcggcggactggccgtcggtgtcgacgacctggcgctccacgtcccctgggccacaccggccgatccggcgacctggcgtctgggcctcgccgggctggccgtctcctacagcgggccgagcgtcagtgtggtcggcgggctgcgcaggcgcgagcgcgacggcggtgtggagtacgcggggatgctcaaggtcgaggcggcgggcttcggcctcaccgccgtcggcgcgtacggcacgtaccccgtcgtcggcaccgcggagcgctacacgtcgatgttcggcatcgccgcgatcgccgcgccgatcggtggtccgcccgccttcttcatcacgggcatcggtgccggactcggcctcaaccgcggactggtgttgcccggcaaggtgaccgacgtcggagagttcccgctcgtggcggccatggatccgagcagccaactggtccgcgagccgatgaaggcgctggactcgatgggccggacgttcccgccgcggcgcggggcgttctggctggccgcgggtgtccggttcaccagcttcacggtcgtggagtccgtggccgtgctggccgtgaccttcgaccacgacgtcgaggtggtcctgctcggtctgtgccggatggaactgcccaaccccgcgaagcccatcgtctccatcgagctggcgctgcgggcgcgcttctccgcgcgcgaggcggtcctgtccgtcgaggcgcagctgaccgacaactcgtggctgctgaaccgcgactgccgggtcagcggcgggttcgccatggtgatctggttccgcaccggcgagttcgtcctgtccctgggcggctaccatccgcgcttcgcgaaaccggcccactatcccgacgtgccccggctgggcattcactggcgggtcagtgacgccatcgcgatcaagggcgagagctacttcacgctcacctccagctgcgtcatggcaggggcccgcgtggaggccgccttcgacggcgggttcgtccaggcgtccttcgtcgcgggcgtggacgcgctggtctcctgggatcccttcttctacgacgtcggggtgtacgtcgcggtcagcgcccgtctggagatcgacatccgggtgtggttcgtgcacgtccggatcacgatcggcttctcgatcgcggcccaactgaccgtgcagggcccggacgtacgcggagtggccgtcctggatctcgatgtgtccaaggtcgaggtcgccttcggcgccgtcgacgccccgggctctccgccgccgctgggctgggcggcgttccacgacaagtacctcgtcgccggtgacccgcacggcgagacgatgagcctgaccgtacgggcggggggcgccgcccgcgatccgggcggcgcgacgggcgcacccgaggacggcagccgggagcggccgctgctgctcacctcggagttcaccctcgcctccaccacgcgtaccgcgagcaaccgggccggcggcgaggtgctgagcggtccggcgctggacctcggcccgatgcggcgagtcgacgtggtgtccgaacaccgcgtggagatggtccggctggacgccgacggcaagccggtcggcaccccggtcgacctggcgtcgacggcggtacgaggcaatgtgcccgacggcgtgtggcgctggttcgacgacgtggagctggacgagggcggcgtccgcgaagcgttcaccggcctggttctcagcgcggtcacccgcctgggcggcggactcaccaccggctccgtcgatgaggtcgaccccggtccgcgacggcccctgccgctgagcgacgaccgcgacccggcgggcgtccggtccgccgccatggaggccgccgtgcggtggtcgcgcactcagtccggtgcgaacacgctggaccgggcgactgagttcctcgtacgcggtgccgggttcgcggccttcggccggtgtctgagcggcgagccgagcaggccgagcgacttcgccctcgcgctgctgccggccgaccgcatctcgccgccccggctggccaggatcaccgagggcctggtgacgccggcccggccgcccctgccgctcaccccgcggcaggcgccgcagcagccggatcccgagccgccgcgcgtcgcgcctccggtgttgctcgcgtccctgcggccgccggtcggcccggtccgccgcgacgggcggaccaccgtgcgcgtcccgcggtggccgcgccgagccgcgcccaccctggccgaggcccgtgagcaggcgctgcccacggccgcccagctcttcacccggcccgcgctcgcggaccgggtcggggcctctggggcgaccgcacgggaccgcgggcggcgtttctcccgcagtggggaggaacgggaggtgctgcgtggcctgttgagcgtcgaccgctcggcgccgtggctgcgttcgggtgagcgggacatcgtggacggtggtccggtgcggctcggggcgggccagatccaggtgtggcggctgcggcgcgccgccgaggacgtccgggccgaacggccgcggctggccgtcaccggcgatcagcgggtgcggatcgtggcgctcgaccgggccggggccgcgcttgtcgactccgaggtggcgggcacggcggaggtcccggttccccggggcacccaactcctcgccctcatcggcctgggcacgacgccgacggcgaaccggcccaggcgcgcgggcctctccggctggcacccggggtcgttcggcgcacaggtgatgccgggcaccgtcctcgtgcccggcgcccgggtcagcaccgccgcccccggctccaagcgcggactgcgcccggcacgggtcgccctcgtcacgggcttcgacctggtcggacggcaggggctgaccaccaccgaactgcccgcctccacgcactcggtcgtcgtcgtgctgtccgccgcggggccggtcaaggacaccgacgggctgctgctgggcctcgacggtgcccagcgggcccgcggcgccacggagccgacgccgcccctcgcggtcgagcagggcgggcagaccgtgctgctctacccggtgacaccgcagggcggatccccggtgtcggtcacgaccggccacgacgaacggtggcgtccctcaggtgtgctgggcagcgcgcagccggcggagcgggtggcccgcgcgatcctccggtacggcctgcccgccctcaccggcgacctggcgggcgagggctccggccgctcggccgtgacgtggatcggagacgtgtgatgacagagctcggcgagggacagttccgcctgcacggcttcgcccggccgccggtgacggcgggaccgcacctggtgcgcatgacacagtcggtcgaccagggcgatccgatcgccccggtggaacgtcacgcgctcgtcaccgctccccagttcgcgctccctccgggggagttgcgcagcgtctttcccccgccggaggcggtcggccctttcgacacccgcttcgcccaggtggcgctgcgccgccgcaccctgccctgggagcggctggtcaccgtcggcctcgatccgcagcgccgcccgtggctggccctcgtcctgctcacgcagagcgagggcgacgtcgtcaccggggtgccggtgagcaccgcggtccccgcgtccctgcacggcgcactcggcatcagcggggcttcggggacctgcgaccggctggacacgaccagggacgtggtccaggcgctgttcccgcgccccgacgaactggaactgctgtgccacgtgcgtgaggtgtcgctcggcgactcggagctctcggtcggtgacgacgacggattcctggccgtggtgatctgtgcccggctgccccgcccgggactcgcgtaccgggcgtgtctggtctcgctggagggccggatcgcggaactgcccgccgccaccggggatccggccagcggtcccggaggtgccgaggccgctcccggtggcgcgggcgtcagcttcccggtcctcgcccactggcggttccgttgcgcggcggagcccggcgacttcgactccctcatgaaggggctccatgtggggtcgctgggcaccgtacggggcaagtgcccggccgtcgcgcccagcgggcacaccgtcatcggtcacaccacgcggcgcggcgaggagacggccgcctggtaccggggaccgctgaccccgcgcgaggtgccccgccggcctgcgggcagcccctgtctgacggcggaccagggccgggctgtcgccgccgacgggctggaggacctcacggtggccgccgcccacgaggtcggccggctgctcgcgctgtcgtccccgcggttcctcgcctcgctgcgcgactggcgcaggcggaccctggccgccgacgcggtggccgccgccctcgaactgcttccggaagtacgggacttgggcctcacccggctcacggtgggccagggtctgggcctggcgctgatcggcacgctcgtcgacggccgcgagccgctgggcgccccggtcccgctcgccgacgccgagtgggcactgccgcagttcccgcccgatgtcatcgtgtccggcacgggtctgccacgggatctcgtacggcagatcctcggcgacctgccggtgctcaccgaccccgaccccacaccgcccgcctcgcccctcgaccagaccttcgacggcctgcggcagacccccgaccagctcgccccgctccgtgacgccctgcgcgaacgggtccggtggatcgcccggcaggcggggctggacccggacaccacgctgttcgaccccgcctacgcgcccaccacgttggaggagctcttcccatgagcacccgataccgttccgaggccgccgtcgagcaggtgctgaccgccgccgccggcaaggtcagcgcgggcgagccacccccggacgacgtactcgactggctcgcccggctgcgcctgctggaaggggtccccttcgcctacctcgtcaccgacgaacgtctcctgccgctcgaatccgcgcgtttcttcttcctcgaccggaactggacggacgcggccgtggacggcgcgctctcggcaggcccctccaccacgcgggaccgggcccatctcgtggcgcggcacggccggatccgcgacgccgtggatgcctcggaacgcaatgtgtggatcaaggcggcgcgaccgggcctgtcctacgacgcggaaccggtcggcacggtcacgggtttcctgctgcgctcccgtgcggtctccggctggccggggctgcgcgcgcaggcattccacgaggggcagccggtcaggccgctgcggatcgaacgcctggcgcccgccgtgctgttggcgctgttcgacggcctgcccacccgcgtcctggtcgaagagccgcaccaggggctgcagttcggcgtggacctggcggacggcggcgtgttcaccgtcgcgcgccgcccgccggagccagaaggcgccgccaccgtgctgttccgtccctcgggctgcggtgtcgtggacgtgcgcaggctttgggccgatctcggtcacacgacagccgccgacggcgccgcgaccttcgcgctccacctcgtgcagcgcccgtatcagcaggagttctccgggacgggagaaggcccgctgttcagcccgtcgatctccctggacgacctcgccgcggccttcgaggagtcgccgtgaccgaggcgtttcccctgcacccggccttcgcggtcaccgcgcgcaccggcctgaccgccgcggcctcccgctcctgggcggccggactgcaccgcgggccccggctgctggtgccggtcgacgtgcaggcactggtcgtgcacgaaggccacgcggaagccagggccgacatcggactgcggctgttcgacgggctgtccagggacccgtccgcgccgggaccgcgcacgtccgcgcccttcactccggccgccccgctcggccccggtgtccatctgcactgggcgctgccggacgcgctgacccacgcggtggcggacagcccgggggcggagccggtctggcagccgctgcccgaccgctgggtcgtggtccggctcggccactacaccgggcagccccgcgcggtgcaggcgtgggtcctggaggcggagaagggcggcagcggcgcgctcgacggatggcagccgggcggcgcccgcgcctatcgcaccccgcagctccgcccggagcagctcaccgccgtctgcggcggcgacccggcctgggccgccgcatacgacaacgtggccgagcggttcgcccattacgacgactggtccacggttcccgcactgcaccgcagagcgctggcctacgtcgtggtcggctggtactcccgccccgaactcgacccggtcgcggcggccgacactcccgccgcgttccgtgccctcctggaccggctcggctggcaggtggacaccgcccggctcacccgcgcccaggccgaggccgagcgctccacgacgcaggccgaggcgctcggccgacggtcggccgacctgccgcccccggcctcccccgcgctcgccggcctcctcggggcacagcagcccgccgccgacccgcacgcctggtggccccggcagaccgtcttccacggcgtggtgtacggggtgcacgcggattccgcttcggccgtggatccccggcccgagccgggggcaccacgggtggcgatcggggccacctccgcggaggcgctcgccgccctcgtcgccggtgaactgaaccgcccggacaccgagatcctctaccaggccttcgcgcacgggctcgccacgacgctcggcgaacccgacgggctgcctcggatcgaggaggagatccacgcccggggcttcgtggcgcgccccggagcggcccgcgcggaacgcgtcgccaccggcgacccgttcaccggtctgcggcccaccacacccccgaccccggccctggaccgggtccgcgcggataccgcgtccggtatcccggacttcgtggtgggccgtgccgtcctcgcggacctgcacctgatcgagaaccaaccggaacgggtggcaccgcccgccgatcctcgccgcaccgagacagtgcaacggcccctgccccggcggttccacccccaggaccccgtgctcgtgatgcggggcctgcgccggtccctgcggcacgggtacgacggggtccgcaccccgggtgaacgcctggcctgccggctgaccggggacacggtgacacgcctggcgggtgtcatcgacgggcgggacctgctggcacgcggactggaccacggctcgctcccggccgaggccgaggcgctggtcgtcgaggcggcggtcgaggatccgtacgccgattacatcgaagcgctcggccgtctccaccggtacgggctgccgccggaggaggccgcgcggcggctgcgggccgagggggccatgatggtctggtccctggccttcccgagccgtgccgcgccgctcacccatctgtccctcaaggacggcacgggatcctcgccggtagggatcaccctgtggcgccaggcatgggtgccgctgtggtgcgagtgggaactggaatggaatccccatccggacgccggggactgggagttgggtgaactcgacttcgatccgcactccgctgccggattctcccagaccggtgccaccgtgctgcggggacggtcctcactcgtctcggcgccgtcgcgggcgctcggggacgagatctcccggttcctggccgaggaggaccggctcgatctgcgcggcgagggcaggatcgacgacgcgctcgcgagccggttgcgccggctctcggccgatcagggggtgcccgacctggtgtcggcgggcttcgacgggctgcgtgagcgcatgctcggcttcaccgacgacgtggcgctcacccccggtgtcccgccggcaccgacggaaccgcccgacctgctgcgggccgggttcgcccggctgcggcaactgcgggtggtggacgcgttcggccggaccgtggatctgctggacccggcgaccccgcccgcgtacgtcgggtcggggctgcgcggcccggcccgggacgtcttcgcactgccgccgcgcgtcaaccagcccgcgacgctgtccttccggctcgtcgacgcctccgacgaactgcgcgaggcgggcatcgaccagcaggagggcgcggcgagcccgctggccggctggctgctcgccgaccacgcggacggggcggtggagttcttcgcgcccggtggccgtgcgctcggtcagctcgcacacgacgcgctgtccggtgccgtggtctgggagggcccgccgggacatcgtgcgccggtgggcgccccgccgtcggcggccttcggcggacagccgcgcctgcggcatctcctgggcctggccgaggggttgatcgaccgcgacagccgggaacgcgccaccggtgtctcccggtccgacaccccgttggacgcgctgctgcgtatcgtcgacacgacctcgacgacggtcggagcgggcggcctgaccggcagcgaacacaccgcgcagctcgtgggaaggccgatcgctgtggtacgtgcccggctgatgctggacatcgaaccggagggcgagcatcctgccctgtccccggccgcgcgggccgggcgcgccgcggcctgggcgtggttggccggacggcggttccccgttcgtctcggcgcgctgacccgtctcgacgacggcctcctggcctacttcgtggacgacgactacggcctgatccaccccgtccacgccgacgtggcgcgggtcgccactccctcgggcaggcaccggggtgatttcgccgccctcggacaacgcgccacgactccccggccgatcggcaccccgaccgtggccgacggttccgcgctgtccctgctgcccggccggtccctgaggctcaccctgctcatggatccggccgccaaggtccacgccacctccgggatactgccccgcaagagcgtggatctgctgcgcgactggttcgcggaggatctggcccggctggtgccgtcggtgcgggtcgggcccgtcctcgtcgatccggccaccatccgtatgccgctcacgcccgcgccggacggcgagcggctgtggacccggcgcaccgcgcccctgtcctggcgcgacgaccccgtcgtggccgccacccagcaggccttgctgccggaggtaccggcatgggcccaggaaggctatctgcgcctcgcaccggaagcgcgggaagcgcctcaggacgggggcaccgggtgagttccgcactggcacggctgtcagcggcggcgctggggcagccgccgccccagccgccccggatcggcatcgagatccaccaggtgctgatccggccgcgcgtaccgcgcccggacgagcctgcgctgaccgaggtcgaccagttcggcagcctggccgggctcgtcgtcgggccgctgcccgccgacttcacgctggtgacgatcggccgggtgaccgtggacgggcggggcacggacgcgttgcgcgtggcggccgaagtcgaccgggcctacctcaccggggagacggcctgggtgctgccgcccacctcggccggctacttccggcaggagacccgcgtcgatctgcggaccgacctgccgtctcctcgctacctggactaccgaatcctggccggcactccccggcgtgtggccgccgaacagccggtccgactggagacggcgaccctcgacggtttcctcgaactcgccgaggagggcgagagcgagcgtcccgcgggcaggacccacctcgagtacctgacctcggtgcgcaagctccgggtggattccgaactggaccagtaccggcagcggatgatccagaaccggcggaacatccccccgtacgaccagacgccgggctcgtcctgggagctgccccgccgggccgcccggctggccgcgctgctgcgggtgcagcacggcttcgagcggctcgacctggcgcaggtgctggccggcatcgacggggccgaccggcagacgcccggccccctggacccggcccctcgagcggatctcgccctcacctggagcggtgacctcgggcgcgccctcgccgcgtacgtccgcgcccgccacgcgcccggggtgccggccgcggaccgcggtcggtcgctggaccactgggtcgcccgccacgcttcgacgccgcggctgctgggcgacatcgacggggtgaacctcggcgagtccttcgacccgcaccgctcgctggcggcgcagctgcgtgagtactacgacggcgccgtggaccggcgttgcaccgcgttcgtcgccgccaccaggaccagtgccggagcgccggcgctccccctggcacctggcttcggcccgcctcgcttcgccgacgccgcggtcggcttcgtcgccggggagatcgtcgcgttcgccgtcgacttcctgcgcttcgcactcggcggcgcgttcgagagcgtgcgcagccgtgccgaggccatgctcgcgccggactctcccgaggtactgcaactgacacaccgcttgctgcacttcgtcgaggcggggctggccgccgaactctcaccaccgtcggacacggccctggtgatcctgcgccgcgacggcagcccgatccccggattcaccgtacggctcatcccgccatcgggaggacggcattccgggatcgcggccacgacggacgcgctgggcaccctcatggttcccgacgccgggacgcgtgcctggacggtcgcctgcgccgaccacgagctggcacccgccgccgaagccaccgaccccgtgcccgtgaccgaactgcggcccggccgcacgccactcgatctgccccgccaccaccggctcccgcccggtacgacgacggagctggtcgcccgcgaggtgctcgttctcgtctgcccccggtgcgatgcggcgctcagggtcgtggaaccgccgccgcgctccctcgaatgcccccgcgacggctacgacctgtcggaactccgcaccaccgtgatcaccgacatcggccggttcaacgcgccggtctcggggcagcgcccgcaccggactcccctgaggctgacgtcctgcggcacccggccggtcgacaccgcgcacggccccgtcgccgcctgctgggacgagtcgcgcttcctgcatccggcgagcggcgactacgagttgtgggccatgacaccgcgagggccgctgaccgtgtccgtcgtcggccgcgccacctggggggcggccccgccgcagatcgaccccccgctgcgtacctgggatttccacgaggccgcctccggccccctcgcgccaccgccctaccgcggcagtcccgtaccgctcagcgagaaccggcccctggcctccgtctaccgctggatcaccatccaccactcggccgaccccgtcacgtacacgcatgagggcccgcgcacgatccagcgggcgcacttcgcggacgacaaggccgacatcggttaccactacatcatcgacggcgccgggacgatctacgaggggcggccactcggcatcgagggctcacacgctgaactcttcaacgccggcaatctcggcatcgtgctcaccggcgacttcggaccgcgctggcagaaccagtgggcacgctacgaccacccgacgcccaagcaactcacaacactcgacgtcctcgtggacgtcctggccgtccgcttcggcatcagcagcgtctggggccaccagccgcgcaagaagcagtcccgggccccggcatccacccagtgccccggtgagtacctcatgagccatgtcgacgaactgcgcctcgtgtacccgggtgatccattctgaacggccccgcccaggccgtgcaccgtgtgcgccggcgcccctcaggaaccgatcggtggtcgcgccaccgtgaccaggccgctctcgtacgcgacgatcaccaactgagcgcgatcgcgggtggcgagcttggtgagcaggtggctgacgtgggtcttcacggtggcaatgccgagatacagccgctcggcgatctcggtgttggacaggccgcaggcgatgagggtgaggacttcacgttcgcgctcggtcacgccgtccagggtgcgacgcagcggtcgcgagggctccgggcggtggacgaactccgcgatcaggcgccgcgtcacggccggtgccagcagcgcctcgccggcggcgatgacccgtaccgccgcgagcaactcgctgggcggcgtgtccttcagcaggaagccgctggcaccggcccgcagcgcggcgtagacgtactcgtccaggtcgaacatcgtcaggatcagcactttgacgtccgcggtctcgggggaaccgcagatctgccgggtcgcctcgatgccatccatttcgggcatccgcacgtccatcaggaccacgtccggcggatcctgccgggcaagccgcaccgcctccgtgccggtcgccgcctccgacgtggccaccaggccgggctcggtgtcgacgagcacccgcaggctgccgcgcagcagcgcctggtcgtcggcgatgaggacccggaccggggcaccgggcggatcggcgggccgggtcatgtgttctcctcgtacggcagggacgcgtgtaccgcgaagccgccctctggacgcggtccggcggcgaaggtgccgccgtacagggcgacgcgttcgcgcatgccgacgattccgtggccgccgggcttcggcgcgagggggctccggtcgcctccgtcgtcggttatctcgagccggacgccgtggccgttcgcatcgaccgccacccggcagcgggcctccgggccggcgtgcttggcgacattggtgagcgcctcctgcacgatccggtagacggccagcgcgactccgtcgggcagactctcgacaccgcgcatagtcagctgcgcgccggcctgcccgacgaggtcagggagagcaagggcgccaggcagcgggccgagagccgctgactgccgctcaccctcggacgtacgcagcacaccgagcatccggcgcatgtcgttcagcgcggtgcggctcgtgcgttcgatgacctggagcgcgtcgtacgcctcctgcggcctgatgtgcaacacgtggttggcgacgccgaccttgaccgcgatcaggcccatgctgtgcgtgacgacgtcatgcagttcgcgggctatccgcaggcgttcctccgtgacggcccgttgtgcgagctgctcggccgcccggacggcgaatgcgcgcctctgccgcgcggcgcgtcccagttgccaggcgccgagcagtgcggcgaagccgagcagcagcagaccggggctgccgcgccaccagaaggcctcgccggcacgcgctgctccggcaaggccggccacggtcagcaaagcgatcgccaggccgggtaaccagcgttgccaccagtggcgcgagggcaccgtgacggcgacggtgtagagggcgaacgccgccgacaggaacgggtcccacgccgcgtcccgcacgacggccacggcggtcaccgccagcacgaccgcgaacacgggcaacggccagatccgccgtacggcgacaggcgcagtggccgcggcgatgagcacgagccgctcccacggcaccggggccgggagcggcggcgcggacgacgacgagatgcctgtcggcccggtcgacagcagcgcgcatgcgtaggcgaatacgagcacgccgtccagggcgatgagtcggcgccggctcagtcgccgggccaggatcggatggtcgtcggggtccaccgcggtacctgcatgcaccgctcgaccatatccaggcgtacgccgctccgcctccgtccagcggtggtcaaagccgctcctcctgcagcctgatgcgcggccgcgggtggcggtcattctccaaccgggggtggagaaggggcagtcagccccgagcgggacgcggcgggagcctgtcgtcacggaccatcaccggcatgatcgaagtcacggatctgaccaagcgctacgggaccaccaccgttgtggagggtcttaccttccaggtacggaccggtcgggtgaccggattccttggccccaacggcgccgggaagtccaccgcgatgcgcatgatgctgggcctggaccgcccgacggccggcgaggtacgcatcgacggcgcgccctaccagcggctccgcgacccgctgcggacggtgggggcactgctcgacgccagggcggtgcaccccggccgaaccgcgctgaaccacttgcgctggctggcccgcagcaaccggatcccgccccgccgcgtccgtgaggtgatcgagctggcgggcctgcggagcgccgtgcgccggcgggcggggacgttctcgctgggcatgagtcagcggctgggaatcgccgcggcgctgctcggcgaccccgccgtcctggtgctcgacgagccggtcaacgggctcgacccggaaggcgtcctgtggctgcggcacctcatgcgggacctggcggcacagggacgcaccgtcttcgtgtccagccatctgatgagcgaggcggcgctcaccgtggaccacctcgtcatcatcggccgcggtcggctcctcgcggacaccagcatgagcgagttcatcgacaggtacacggacgtgggggtgcgggtgcgcactccggaaccgcggcggctgcgcgacgtgctggtcggcgcgggaatcacggtcaccgactgctccgacggcagcctgaaggtggccgccgccgcggagcggatcggcgaactcgtcgcggcgcacgccgtgacggtgcacgaggtgacgcggaagaccgtgtctctcgaagaggcgttcatgcggctgaccgctgccgcggtcgagtaccgggcggagtcgccgggaggagtacgccgatgaccagcaactcgccccgagcggttctcgccgccgagtggatcaaggtgtggaccgtacgctcgaccagcttcaccctgctgctggccttcgtgctcagcaccggcctcggcaccgttgtcgcgttcagctggcgtggccacatcgagcgcgtcgtcaacttcagtccgctcttcgccggcctgtacggcgtgaccctcgggcagctcgccctcgttgtgttcggcgtcctgctcgtcggctccgagtactcttccggatcgatccggacgtcactgtccgcggtgccccggcgtgggctgctctacggcggcaaggtactggccggcacactggccgccctcgccggctcgacggtcaccgtgatcgtcacgttcgcgggggcgcaggcggccctcggcccgtacggcatcacgctcactgcgcacggggtcccggctgcggtggtcggcgccattgtctacctgacgctgatctgcaccttgtccatggggatcgcggccatcgtgcgcagctcggccatctcgctcggcgtccttctcccgctgctgttcctcggctcccagggactcggcaacgtccccgccctgaagcccgtcctgcagtacctgcccgaccaggccggcctggaactgatgcgtattgccggacctcccggcgacggacgcttcggccccgactacgggcccagcacggctctcgtcatcctgctggcctggactgccgccgccctgaccggcggctacctggtcctgcgccgacgggacgcctgacgcctggtcctccgaactccccataggccaggccgccttcgcgccgccgtccctctggacccttgctcgcgggtgcggcgatggccttctcctccggctcgggcggtcaatccgcccgagccgtttccgcggtcaccgcaccgccatacataccggtcacccggtattccattcggtgttgcagcacgcgacccactgcgcatcccactcgtgaattgtggaccgccatccggggcacggatgtctccaggaaggaactccttcaccctcgcgaacaccacctcagaatcccacgatcatcagttaatcatcaaagtcagcgaccttgacactaccccgcccaccagggcaaattcataacactgaccatcacctctgatgctgatcaacccagcccgcacggccgcgaccgcttttgctcaagcaatcgaaatccccgagacacgctttcttggaaaaaggagaaataagaacatcatgcagggagtttcctgtctgcacccccctcggaaaccagaagaactcacgctcgtcgaccgggaaacacagttccgcgcgctgcggctggcccttaccgaatgcgcggccggcacggtgaaactgctcgtcgccgagggcggaatgggctgtggaaagagtacgttcctgggcgaggcactgcacaccgccgccgcctccggcttcgccgtcctgcgtgccgccgggcttcccgcggaccaccggcaacccctcggcgtactgcagcaactgctgaacgaccccgcccccgaggacaccgcccgcaccgccgtccgccccatgccggtgcaacacgtccgcggcgccctcgaacgcctcgccgccggcgccccgctggcgatcggcatcgacgacgtacaggacgcggacccggagtcgctgcactgtctgatgcgcctcacccgccactcccccacctcgcggatcctgctgctgtgcaccgccctggcgtgcagtccggccgccgacccggtactcgaagccgagctgatgcgtcagaccgccttcgaacgcatcacgctggactgcctgtccctggacggagtgaccgggctggtctcggaccgctgcgcgcggcccacggcgcccccgccggcggactactgcctgaccgtcaccgggggcaacccgctgctgctgcgggccctgctcgaagagcacagcgaggccgacgccccctcggcaccccgcccggcggagccctccgcgctgcactccccgccgcaggccgccccgccgcgcccggtcgtcggcggccgcttctaccagtccgtactggcctgcctgtcccgcacggagacggcgatcaggcagacggccggcgccctcgccgtcctcggcgggcgtgcgcgcgccgacctgctcccccaactgctcggcgcgagtcccgcgtcggtcacccgggggctgcgtgcgctggaggcgacggggctgaccacctccggccgtttccggcacccggtggccgaggccgccgcgctcgacgcactggacccgagccgccgtgcccacctgcaccgccgagcggcggcgctgcagcaccacgacggcgcggcgccgcgggacgtcgcccgccaccttctcgcggcccgccatgcggcgggcccctgggcggtgtccgtgctgcgtgacgccgccgagcagtcgctggcgcaggacgacgtggcgtcggcggtctcctgcctggaactcgcctacggggcctgtgtccgggaacgggaacgtccggagatcaggatcaggctcgccgccgctttcgggcgcaccaacatcgcggtggcggaagagcacctcgccgacctggtcgccaccttgcgggaaggagaattgaccggccatcagacggctttactcgtccctctgctcgtcaaccacggccgcctcggcgaagcgcgggaggcgatggaccggctcaacgccgccgacgacgcgcgcggcctgtgcgcggacggcggcttcccgatggccgctccgtggccgtcgaccgcacacctcgccgcacgccgcgatcccgccgcgcgccgcgatcccggcacccgccgcgatcccgccgacaagccgttcctgccccggcagtccggtgccccgcagccccggccggaggacggccgtggccagcagccgacagcggccttgtgggccctgcccggaaacggcaccagcgaggcggccgcacacgccgcggaacaggtactgcggtcctccccgctcaccgacagcaccctcgtgctcctggtgaacgccgtgcggatcctcgcccgcacgggccggtacgacaccgcggacatctggtgccaccgcctgctcggcgaggccacccgtcgccgttgtcccggctggcaggcgcacctcctggcggtgcgggccgaactctcgctgtgccgtggcctgctcgccgacgccaaggagtgcgcccagcgcgcactgacacacgtaccggggcacagccgcagcgtcttcgcgggcggtccgctggcctgccaggtcctcgcctgcaccgcgatgggacgctacgacgaagccacgcaactgctcagccatccggttcccgaggcgctgttccacagtgtgtacggcctggggtacctgcgggcccggggccatttccacctggccatgaaccgcctgcccgccgccgtccgcgacttcctcaccgccggccgggtggcgcgggagtggggactggaccatccggtgctgctgccctggcgtacggacgccgcggaggcgttcctccggctcggggaaacgaagagggccgaccaactcctcaccgaacagctcgtctccccgcacagcggcaacccgtacgtccgcggcaccgcgctgcgcctgcgggcccagaccgcggcgccggcggaacggctccggctgctgagcgaggcggtcagtgacctccagagctccggcgaccgcctggcgctggcccgcgcactggccgatctcggcgccgcgtatcacagccggaacgagcccgtacgggcgagcgccacggtccgccgcgcctggcagctggccaaggagtgcggagcccaggccctgtgcgacagcatcctgcccagtcgcggcaccaaggaccgggggcccgacggaagggcggccgcgaccgaggccctgctgagcgagtccgagatgcgagtcgcgacactggcggcgggcggcaacaccaaccgtgagatcgccggccggctctgcgtcaccgtcagcacggtcgaacagcatctgacgcgggtctaccgcaaactgaacatcacccgccgcagggagctgccgacccgtctgcgacacctcgcggaccaggccaactgaccacgggagggggggcgtcccggccgacgtgtgctcgtcttccgcctcacgacatggcgggcgcgatgcacagccccccactcgcatccaccaactgaccggtgacccaacggccttcgtcggaggcgaggaaggccaccacaccggcgatgtcccctggacgccccaggcggcgcagcgcggtgagggcggaaatgcgttcctcgaccccgggcacatcgcgcatcgcgcggttcatgtcggtggcggtgatcccgggagcgacggtgttgaccgtgatgccgcgcgcgccgagctcaagggccaggcgcggcgcgatcatttccagggcacccttgctcatggcgtacggcaggagcggccaggcgatccgggtgagggcggacgagacgttgatgacgcgtccgccctcaccgatgagccgcagggcccgctggatgatgaagaacggggcccgcacattgatcctgaacaggtgatcgaactccgcggcggtgacgccggagacgctggtgacgtcctcaccctttcccccggctccctccggtgcggggggcgactgcaccccggcgttgttcaccaggacatggagcgggcgcccgtccagacggttctcgacttctgcgaacagggtgtcgacggcgtcgtcgcggcggaggtcggcccggaccgggaaggcctccccgccgacccgttcgatggcctcgaccgtttccgcggccgccttttcctggctgccgtagtgaacggccaccagaagaccttccgcggcgagccgttgggcaatcgccctgccgattccgcgtgaggctccggtgacgagagccgcccttcccttgagatccgccacgatgaaattccccttttcggaaagcaggcacggtgttcctgaagtgatgagcgattccaccattcgagtgacggcaacgggaataccgcggccgcactcacgcaccgccgtaccgttcccagacaggccataccggccccaggcagaacggaccggtttcccacgtcaggaaaggtggatggtgcgtgaccgacctcaatcagggcggacgcgaaggaacgccgcgaggcgctgtgtcccgacccgaacgcgtctccgagcccccgcaggccggtgcggcggccccgtacgcgggccacgcccggcgcgggctgagcgccggatcacgcgcccagtgcctcgcggcgccacccgcgccgccgcggcggagacgtcccgcgcggctcgtgagccggggccggtggccgacgccatggatccggccgcggtgaccgccgccatcatgaccgccgcggataccgccacggcggccgccacccgcgccaggacggccgccgagagggccttggcggcgagttcacgcgacgctgccgccgccgaggccgccgcggccgcggaagctgcggcctcggcggcctcggcttgggccgacgccgcgtccgtcgcggcggacgccacaacggcagcggccgagaccctcgacgacctgcgcgccgtggcccggcgcaccagggacatcgcggcccagaccgtggccgtcgcacaggcagcggccaccgcggcgacagcggcccggaccgccgccgaccgtggtgccgtagacctcggcgtggaatccgccgcctgcgaggccgaggacagggccctgcacctgatgacggaaatcccctggctgagccggcatctgccggccgagtgagcggcgcgtcgacagcgttgccgcatcactcccccgggcgccgggcggtcagcacgacatagccgatgtccggcgtccaggggagcgtcgtgcactgtgcaaccaccttccgcatctccgcgacgccgatcccgaaggccgccgcgtactcgtcgaggtgctcgttcacgtggtcacgcagcgcggcgaaagaggggccgacgacctgatcgccgatgtcggtcagctcatgcagttccagcccggcgtcggcgatcattccggcgtactcgtcgatgtgcaccagggccgggaccgcgagcaactgggacgtgcactccccgcgcttcatgccggtccgcccgaaggcgcgcagtgcgacgtccgtgacggccagccggccgccggggcggagcacccgggcgatctcccggatcacctgtgcggggctgggcatgtgcaggagacactccagggcccacgccgcgtcgaaggacccgtcgggaaacggcagttccatcgcgtcggcacgggtgaacacgacccggtccgccacgtgcgactgcttcgcgagagcggtcgccagcccgacctgaacctcgctcaccgtcacgccgacgacatcgacgggcgcgctcagggcgagccgcaccgccggctttccggaaccgcagccgacgtccaggacccggcggcccgtgatgcctctcagcttgccgatgaggagatcggtgagccggtcggcggccttgcccggtgaactgccgtcccccggctgcggccagtatccgaggtgggtgttcccacccagcgcacgattcatgaggtcggtcaaacggtcgtagtagtcccccacttccagggaagagggcggggtctgctccgggacggccatcatggtcgggaacctccgcaatccgggccgggcggcccagctgtcgtggcgatctactccaggaaacgtagacctttttctgccacttgtccgagctatgcagacaccccgatcccctaagaaatgaacacccttgggaacggcacagcccaggggtggataggggtattcgccgccgccgcgccgtcattagctttgaagagttgaagacgttcaagacattgatgcccggccgtcagcggatttctcgcgctcctttcattcttcgacgctgcattgcagctctcatcatgtccgcacggccgccgagcattgcctagcggtgaggacacagctcaggtgcagaggatggacggcggggaagaaccccgccctgcggcaggggaggtcctcggagtggccgacgaggcggacggcggcgtcgtcttcgtttttcccgggcagggcccgcaatggccgggcatgggaagggaacttctcgacgcttccgacgtcttccgggagagcgtccgcgcctgcgaagccgcgttcgcgccctacgtcgactggtcggtggagcaggtgttgcgggactcgccggacgctcccgggctggaccgggtggacgtcgtccagccgaccctgttcgccgtcatgatctccctggccgccctctggcgctcgcaaggggtcgagccgtgcgcggtgctgggacacagcctgggcgagatcgcggcagcccacgtctcgggaggcctgtccctggccgacgccgcacgcgtggtgacgctttggagccaggcacagaccacccttgccgggaccggcgcgctcgtctccgtcgccgccacgccggatgagctcctgccccgaatcgctccgtggaccgaggacaacccggcgcggctcgccgtcgcagccgtcaacggaccccggagcacagtcgtttccggtgcccgcgaggccgtcgcggacctggtggccgacctcaccgccgcgcaggtgcgcacgcgcatgatcccggtggacgttcccgcccactcccccctgatgtacgccatcgaggaacgggtcgtcagcggcctgctgcccatcaccccacgcccctcccgcatccccttccactcctcggtgaccggcggccgcctcgacacccgcgagctagacgcggcgtactggtaccgcaacatgtcgagcacggtccggttcgagcccgccgcccggctgcttctgcagcaggggcccaagacgttcgtcgagatgagcccgcacccggtgctgaccatgggcctccaggagctcgccccggacctgggcgacaccaccggcaccgccgacaccgtgatcatgggcacgctgcgccgcggccagggcaccctggaccacttcctgacgtctctcgcccaactacgggggcatggtgagacgtcggcgaccaccgtcctctcggcacgcctgaccgcgctgtcccccacgcagcagcagtcgctgctcctggacctggtgcgcgcccacaccatggcggtgctgaacgacgacggaaacgagcgcaccgcgtcggatgccggcccatcggcgagtttcgcccacctcggcttcgactccgtcatgggtgtcgaactgcgcaaccgcctcagcaaggccacgggcctgcggttgcccgtgacgctcatcttcgaccacaccacgccggccgcggtcgccgcgcgccttcggaccgcggcgctcggccacctcgacgaggacaccgcgcccgtaccggactcacccagcggccacggaggcacggcagcggcggacgacccgatcgccatcatcggcatggcatgccgtttcccgggcggagtccggtccccgaaggacctgtgggagctggccgcctcgggcggagacgccatcgggccgttccccaccgaccgcggatggcccacggaacagcgtcacgcccaggaccccacgcagcccggcacgttctatccgcagggaggcgggttccttcacgacgcggcgcacttcgacgccggcttcttcggaatcagtccacgtgaggcactggcgatggatccgcagcagcggctgctgctggagacgtcctgggaggcgttcgagcgggcgggaatcgatccgctgtcggtacgcgggtcccgtacgggcgtcttcgcgggcgccctctccttcgactacggcccgcgtatggacaccgcgtcgtcggagggcgccgcggacgtggagggccacatcctcaccggtaccacgggcagcgtcctgtcgggccgtatcgcctacagcttcgggctggaagggccggcgatcaccgtggacacggggtgctcggcatcgctcgtgacgctgcatctggcgtgccagtcgctgcggtcgggtgagtgcacgctcgcgctggccggcggcgtctcggtcatgtccaccctcggcatgttcatcgagttctcccggcagcgcgggctgtcggtggacggcaggtgcaaggcgtactcggctgcagccgacggcaccggctggggcgagggcgtcgggatgctgttggtggagcggttgtcggatgcggtgcggctggggcatcgggtgctggcggtggtacgcggcagtgcggtcaaccaggacggtgcgtcgaatgggctgacggcgccgaacggtccggctcaggagcgggtgatccggcaggcgttggcgaacgcggggttgtccgtggcggatgtggatgtggtggaggggcacgggacgggcacgacgctgggtgatccgatcgaggcacaggcgttgctcgccacgtacgggcagcgggccggtgacaggccgctgtggctggggtctctgaagtccaacatcgggcacaccatggctgccgcgggtgtgggtggggtcatcaagatggtgatggcgttgcgggagggggtgttgccgcggacgttgcatgtggataagccgtcgccgcaggtggactggtccgcgggggcggtgcggctgctgacggaggcggtgccgtggccgggggacgcggcagggcggttgcggcgggcgggagtgtcgtcgttcgggatcggcggcacgaatgcgcatgtgattttggaggaggcgccggcggcggggggctgtgttgccgggggtggggtgttggagggtgctccgggtcttgccatttcggtggctgagtcggtggccgctccagtggctgtgtctgcgccggtggctgagtcggtgccggtgccggtgccggtgccggttcctgtgccggtgtcggctaggtctgaggctgggttgcgggcgcaggcggaggcgttgcgtcagtacgtggcagtccggccggacgtttcgcttgccgatgtgggtgcgggtctggcctgtgggcgggctgtgctggagcatcgtgcggtcgtcctggccgcggaccgtgaggagctggtgcaagggttgggggcgctggcggcgggtgagccggatcggcgggtgaccacgggtcatgcgccgggtggtgaccggggcggtgtcgtcttcgtgtttcccggacagggtgggcagtgggccgggatgggtgtgcgtctgctcgcctcctctccggtgttcgcccggcggatgcaggcgtgcgaggaggctctggcgccgtgggtggactggtctgtggtggacatcctgcgccgggacgcgggggatgcggtgtgggagcgggccgatgtggtccagcctgtgctgttcagcgtcatggtgtctttggctgctctgtggcgttcctacggtatcgaacccgacgcggtccttggccattcccagggcgagatcgcggccgcgcatgtgtgtggggcgctgagcctgaaggacgcggcgaagactgttgcgctgcgcagccgggcgctggccgctgtgcggggccggggcggcatggcctcagtgccgctgcctgcccaggaggtggagcagctcattggtgagcggtgggcggggcggttgtgggtggcggcggtcaacggcccccgctccaccgccgtctcgggggatgccgaggcggtggacgaggtgctggcgtactgtgccggcaccggggtgcgggcccggcggatcccggtcgactatgcctcgcactgcccccatgtgcagcccctgcgggaggagttgctggagctgctgggggacatcagcccgcagccgtccggcgtgccgttcttctccacggtggagggcacctggctggacaccacaaccctggacgccgcctactggtaccgcaacctgcaccagccggtccgtttcagcgatgccgtccaggccctggcggatgacggacaccgcgtcttcgtcgaagtcagcccccaccccaccctcgtccccgccatcgaagacaccaccgaagacaccgccgaagacgtcaccgcgatcggcagcctccgccgcggcgacaacgacacccgccgcttcctcaccgccctcgcccacacccataccaccggcatcggcacacccaccacctggcaccaccactacacccaccaccacacccacccccacccccacacgcacctcgacctgcccacctaccccttccaacaccagcactactggctcgagagctcacagccgggtgccggatccggttcgggtgccggtgccggttcgggtgccggttccgggcgggcagggactgcgggcgggacggcagaggtggagtcgcggttctgggacgcggtggcccgccaggacctggaaacggtcgcgaccacactcgccgtgcccccctccgccggcctggacacggtggtgcccgcactctccgcctggcaccgccaccaacacgaccaagcccgcatcaacacctggacctaccaggaaacctggaaacccctcaccctccccaccacccaccaaccccaccaaacctggctcatcgccatccccgaaacccagacccaccacccccacatcaccaacatcctcaccaacctccaccaccacggcatcacccccatccccctcaccctcaaccacacccacaccaacccccaacacctccaccacaccctccaccacacccgacaacaagcccaaaaccacaccaccggagccatcaccggcctgctctccctcctcgccctcgacgaaacaccccacccccaccacccccacacacccaccggcaccctcctcaacctcaccctcacccaaacccacacccaaacccacccaccaacccccctctggtacgccaccaccaacgccaccaccacccaccccaacgaccccctcacacaccccacccaagcccaaacctggggactcgcccgcaccaccctcctcgaacaccccacccacaccgccggaatcatcgacctccccaccacccccaccccccacaccctccagcacctcacccaaaccctcacccaaccccaccaccaaacccaactcgccatccgcaccaccggcacccacacccgccgcctcacccccaccaccctcacccccacacaccaaccacccacccccaccccccacggaaccaccctcatcaccggcggaaccggcgccctcgccacccacctcacccaccacctcaccacccaccaacccacccaacacctcctcctcaccagccgaaccggcccccacaccccccacgcacaacacctcaccacccaactccaacaaaaaggcatccacctcaccatcaccacctgcgacaccagcaacccagaccaactccaacaactcctcaacaccatccccccacaacaccccctcaccaccgtcatccacaccgcaggcatcctcgacgacgccaccctcaccaacctcacccccacccaactcaacaacgtcctccgcgccaaagcccacagcgcccacctcctccaccaactcacccaacacacccccctcaccgccttcgtcctctactcctccgccgccgccaccttcggcgcacccggccaagccaactacgccgcagccaacgcctacctcgacgccctcgcccaccaccgccacacccaccacctccccgccaccagcatcgcctggggcacctggcaaggaaacggactcgctgattcggacaaggcccgcgcatatctcgaccgccgcgggtttcgacccatgtcacccgagttggccacggcagcggtcacgcaggcgatcgcggacaccgaacggccgtatgtcgtcatcgccgacatcgactggagcaagatcgaacacacctctcagaccagcgacctggtgagcgcggcccgggaaagggagccagctgtccagcgccccactccaccggcggagttgcacaaaacgctggcccatcagacgtcggccgaccaacgggccgcattgctcgagctcgtacgagaccatgtggcggcagtgctccggcacgcggacccgaaagccatcgcgcccgaccagtcgttccgtgcactcggcttcgattcactcacggccgtcgagttccgaaacctgctgatcaaggcaacaggactccgccttcctgtctcgctggtcttcgaccacccgacccctgccaaactcgccgtacacctgcagaaccaactgcggggcacagcagcggagtcggctccttcagcggcagccgttaccgccgaggcttctgtcaccgagccgatcgccatcgttggcatggcctgtcgtttccccggcggagtgacctcggcggacgacttctgggatctgatctcctccgagcaggacgcgatcggcggattccccaccgaccgcggctgggacctggacacgctctacgaccccgaccccgaccaccccggcacctgctacacccgaaacggcggattcctctacgacgcaggccacttcgacgccgaattcttcggcatcagcccccgcgaagccctcgccatggacccccagcaacgactcctcctcgaaaccgcctgggaaaccatcgaacacgccggcatcaacccccacaccctccacggcacccccaccggagtcttcaccggcaccaacggacaggactacgcacttcgcgtgcacaacgcgggccagtcaaccgatggtttcgcactgaccggaaccgccggcagcgtcatctccggtcgtatctcgtacacgtttggttttgagggtcctgcggtgtcggtggacacggcttgttcctcgtcgttggtggctttgcatctggcctgtcaggcgttgcgtgcgggtgagtgctcgatggcgcttgccgggggtgtgacggtgatgtcgtctccgggtgccttcgtggagttttcgcggcagcggggtctggccgcggacgggcattgcaaggcgttctcggcggcggcggacgggaccggctggggtgagggtgtggggatgctgctggtggagcggctctccgacgcccatcgcaacggtcaccgtgtcctggccgtggtgcgtggcagtgcggtcaaccaggacggtgcgagcaacggtctgaccgcgcccaacgggccgtcccagcagcgtgtcatccgccaggccctcgccaacgccggcttgtcggccggtgatgtcgacgcggtggaggcccacggcaccggcaccactttgggcgacccgatcgaggcccaggccctcctcgcgacctacggacaggaccgtgccggcgaggggccgctgtggctgggctcggtcaagtccaatgtcggtcacacacaggctgccgcgggcgtcgccggggtgatcaagatggtgatggcgctgcggcatggtctgctgccgcggacgttgcatgtggatgagccgtcgccgcatgtggactggtccgcgggtgcggtgcagctgctgacggagacggtgccctggcccggcggggaggggcggctacggcgggcaggagtgtcatcattcggcgtcagcggcaccaacgcccacgtcatcctcgaagaagcacccgccgacgacgttccggggggaccacccgccggcgagggtgacgcgggcagcgacgatgaggctgctgccggcagtcctggggtgtggccgtggctggtgtcggccaagtcgcagccggccctgcgcgcccaggcccaggccctgcacgcccacctcaccgaccaccccggcctcgacctcgcggatgtcggatacaccctcgcccacgcccgcgccgtgttcgaccaccgcgccaccctcatcgccgcggaccgcgacacgttcctgcaagcactccaggcactcgccgcaggcgagccccaccccgccgtcatccacagcagcgccccgggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaaaacgacaacgacaacgaggacgcggccgcactgctccagcagacccgctacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccccaccacatcacccaccacctcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaccacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgactacgccaccaccacccaaaccctccaccaacacggcgtcaccacctacatcgaactcggacccgacaacaccctcaccaccctcacccaccacaacctccccaacccccccaccaccaccctcaccctcacccacccccaccaccacccccaaacccacctcctcaccaacctcgccaaaaccaccaccacctggcacccccaccactacacccaccacgacaaccaaccccacacccacacccacctcgacctccccacctaccccttccaacaccaccactactggctcgaaagcacacagcccggtgccggcaacgtgtcagcagccggactcgaccccaccgaacaccccctactcggcgccacattggaactggcgactgacggtggagcgcttcttgcagggcgcttgtctttgaggtcgcatccgtggctggctgaccatgccgtcggcggcacggtgctgctgtcgggcgccaccttcctcgaactcgcccttcatgcgggcacatacgtgggctgcgaccgagtggatgagctgacgctgcatgcgccgctggtggttcctgtggatgggggtgtgagtgtgcaggttggggttgcggctgcggatggggaggggcggcgtttggtgagtgtgtatgcgcggggtgggagtgcttgtggtgggggtggtgcgtcgggtggggtgtggacgtgtcatgcctcgggggtgctggttgaggctgctgctggtggtgtggtggtggatggtctggcgggggtgtggccgccgcggggtgcggtggcggtggatgtcgatggtgtccgtgaccgtttggctggggctggttgtgttttggggccggtgttttcggggctgcgtgcggtgtggcgtgatgggggggatttgctggctgaggtgtgtctgccggaggaggcgtggggtgatgcggctggttttgggctgcatccggcgttgctggatggtgtggtccagccgttgtcggtgttgcttccgggtgggacggggtttggggagggggcggggttcggggagggtgttcgggtgccggctgtgtggggtggtgtgtcgcttcaccgggcgggtgtgaccggtgtgcgggtgcgtgtgtcggctgtcgggcggggcggcgggcgtgaggcggtgtcggtcgtggtcggggatgaggcgggtgtgccggtggcgtcggtcgatcgtcttgagttgcggcctgtggatatgggtcagttgcgtgctgtctcggtttcggcggggcggcggggttcgctgtatgcggtgcagtgggctgaggtgggtcctgtgccggtgtgtgggcaggcgtgggcgtggcacgaggacgtgggtgagagcggtggtgggcctgtgccgggggtggtggtgttgcggtgcccggatgccggtgccggtggcggtggcggtggcggtggtggcggtggtgtgggtgaggttgttggtggggtgttgggtgtggtgcaggggtggctggggctggagcggtttgcgggttcgcggctggtggtggtgacccggggtgcggtggtggccggcccggaggacggcccggtggatgtggtgggtgcgtcggtgtgggggctggtgcgttcggcgcaggctgagcatccggaccggtttgtcctcctcgacctcgacaccgacaccggcaccgacctcgacaccggtgctggtgctggttggggcgtggatggtgggcgtgtggcggcggtggtggcgtgtggtgagccgcagttggcggtgcgtggggagcggttgctggccgcacgcctgaaacgacttgagtcatccggtgatgttccagcccagcggtccggtgacacacgagcccggcggtccgacgtgcctgcccagcgctccggtggcgtgcctgctcggcggtcggttgatgtatcgggtcgggaggtgttgccgtggttgtcgggtgggtcggtgttggtgacgggtgggacgggtgtgctgggtgcggcggtggcgcggcatctggctggtgtgtgtggggtgcgggatctgctgttggtgagccggcgtggtccggatgctccgggtgcggagggtctgcgggcggagctggccgcgttgggggcggaggtgcggattgttgcgtgtgatgtgggggagcggcgggaggtggtccggctgctggagggtgttcctgccgggtgtccgctgacgggtgtcgtgcatgcggctggtgtgctggacgatgcgacgatcgcctctctcacgcccgagcggctgggcacggtgttcgcggccaaggtggatgccgctcttttgctggatgagctgacgcggggtatggagctgtcggcgttcgtgctgttctcctcggccgcggggatcctggggtcggccgggcagggcaactacgccgcggccaatgccgctctggacgcgctggcgtaccggcggcgggcggcgggtctgccgggggtgtcgctggcgtgggggctgtgggaagaggccagcgggatgaccgggcacctggccggcaccgaccaccggcgcatcatccgttccggtctgcatcccatgtcgaccccggacgcactggccctcttcgatgcggccctggctctggaccggccggtcctgctgcccgccgacctgcgtcccgccccgcccctgccgcccctgctgcaggacctcctgcccgccacccgccgccgcaccacccgcaccaccactaccggtggtgcggacaacggcgcccagctgcacgcccggctggccggccagacacacgaacaacagcacaccaccctcctcgccctggtccgctcccacatcgccaccgtcctgggccacaccacccccgacaccatcccccccgaccgcgcgttccgcgacctcggcttcgactccctcaccgccgtcgaactacgcaaccggctctcccgcaccaccggactccgcctccccaccaccctcgccttcgaccaccccaaccccaccaccctcacccaccacctccacacacaactccagccacaaccggacaacgctgtcgcccccgtgttggcggagctcgacaaactcgaatccgccctctccgccctcgacaaaaccgacagcgccagcgaaagagtcaccctgcggctgaagtcactcatgttgaggtggaacgcaccccagcatccgacagccgaaagcgctgatgacgacgagaagttcacatcggcaacagaggctgagattttcaaattcattgacaacgacctcggcctgtcctgaaccggacgcctgccactccgcccgtatccgctgggccctgctaggacgtgaatgcaattggcgaatgaagcgaagctcctggaatacctcaagcgcgtcactgcggacctggaccgcactcgccgtcgcctgtacgaggtggtcgagcgtgagcaggagccgatcgcgattgtggggatggcgtgtcgttacccaggcggggcgacgtcacccacgcgactgtggcatctcgtcaagtcccagacggacgctatcggggagttcccgaccgaccgtggatggaacctggagcagctctacgacccggaccccgaccgctcaggaaccagttacacgcgcagcggagggtttctctatgacgcgggcgacttcgacgccgcgttcttcgagttgtcaccgcgtgaggcgctggcaatggacccgcagcagcgcctgctgctcgaaaccacttgggaaacgttcgaacagggcggaatcgacccgaggtccatgcgcggaagccggaccggggttttcgtggggatcaatccggaggactacaccaccggatacacacatcagccctcaaacgcagtcgagggctacctgctcactggcagcgcggcaagcattgcgtcaggccgtatctcctacaacttcgggctcgaaggccctgcgatcactatcgacaccgcgtgttcctcctcgctcgtcgccctgcatctggcctgccaagcgctccggtccggtgaatgcaccatggcgctcgcaggcggcgcctccgtcatggccactcccttcgtcttcaccgagttctctcgccagcggggcctggccgcagacggccggtgcaaggcgttttcggcggcggcggacgggaccggctggtccgagggtgtggggatgctgctggtggagcggctctccgacgcccgccgcaacggtcaccgtgtcctggccgtcgtccgcggcagcgccgtcaaccaggacggcgcaagcaacggcctgaccgcacccaacggtcgttcacaagtcaaggtcatccgccaggctttggccaacgcacacctctcccctgccgatgtcgatgcggtggaggcccacggcacggggaccaccctgggcgacccgatcgaggctcaagccctcgtcgaagcctacggtcaggaccgccccaacggccgccccctctggctcggaaccctcaagtccaacatcgggcactccatggccgctgcgggtgtgggcggggtcatcaagatggtgatggcgctgcggaatggtctgctgccgcggacgttgcatgtggatgagccgtcgccgcatgtggactggtccgcgggtgcggtgcagctgctgacggagacggtgccctggcccggcggggaggggcggctacggcgggcaggagtgtcatcattcggcgtcagcggcaccaacgcccacgtcatcctcgaggaagcacccgcccacaacatcccgtcagacacacccgccgacgacgtcccgggagaatcagccgccgacgaggatgccggtagtggcgatgaggctgctgccggcagtccaggggtgtggccgtggctggtgtcggccaagtcgcagccggccctgcgcgcccaggcccaggccctgcacgcccacctcaccgaccaccccggcctcgacctcgccgacgtcgggtacaccctcgcccacgcccgcgccgtgttcgaccaccgcgccaccctcatcgccgccgaccgcgacaccttcctgcaagcactccaggcactcgccgcaggcgaaccccaccccgccgtcatccacagcagcgccccaggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaggaccccaacacccaggacaccaccaccctcgaagaagcggccgcactgctccagcagacccgctacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccccaccacatcacccaccacctcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaccacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgactacgccaccaccacccaaaccctccaccaacacggcgtcaccacctacatcgaactcggacccgacaacaccctcaccaccctcacccacgacaacctccccaacacccccaccaccaccctcaccctcacccacccccaccaccacccccaaacccacctcctcaccaacctcgccaaaaccaccaccacctggcacccccaccactacacccaccaccacaaccaaccccacacccacacccacctcgacctccccacctaccccttccaacaccaccactactggctccaaccacccggcaagccgagcgacccgtcaccgagcgaaggccgtgagcaagccacgaccccatcaaccccgctgcgtgatgtcctcgtgggcaagtctccgcaggagcgagacgaagagctgttgcgcctggtgcgcacccatgcggccgctgtgctgggccatgccactcccgaagtgatcgttccgaacaaggccttcaaagagctgggttttgattctctcgccgcaattcagcttcgtaatcgactgcttgctgacgttgacctgccgcttccggccacgctgatcttcgattaccccactccgatggcgctttgccagttcctccgggcggcgatcgtcggagcggacacaggcacgaccactcgtctgccgctaactgcggtccccgccgacgagccgatcgccatcgtcggcatggcctgtcggtaccccggtgatgtacggacggtcgatgatctctggcaggtggtcagtggtggccatgacgcgatcggcggattcccgacgaaccgtgggtgggacctcgacacgctgtacaacccggacccggaccaccacggaaccagctacacccggagcggcggattcctttacgacgcaggcaatttcgatcccgacttcttcggtatcagtccgcgtgaggcactggcgatggacccgcagcagcggctgctgctggaaacagcgtgggagagcatcgaacacgcctgcatcaaccccgacagcctccgtggcacaccaaccggcgtcttcgccgggctgacctaccacgactacgccgcgcgctttcccacagctccggcagggttcgaggggtatctcgggcacggaagcgcaggcagtatcgcctcgggtcgtgtcgcctacgctctcggcctggaaggtccggccctcacagtcgacactgcctgctcttcgtccctggtcgctctgcacctggcctgtcaggcgctgcggtccggcgagtgttccatggccctcgcgggtggcgtcacggtgatgtcaaccccggccgggttcgtggagttttcgcggcagcggggcctggccgtggacgggcggtgcaaggcgttctcggcagcggctgacggcaccggctggggtgagggtgtcggaatgctgctggtggagcggctgtcggacgcgcggcggctcggtcaccgaatcctcgcggtggtgcgtggcagtgcggtcaatcaggacggtgcgagcaacgggctgacggcgcccaacgggccgtcccaggagcgtgtcatccgcctggccctggccaacgcggacctgacccccgccgacgtcgatgcggtggaggcccacggcaccggcaccactttgggcgacccgatcgaggcccaggccctcctcgccacctacggacaggaccgccccggcaacgaaccgctgtggctgggctcgatgaagtcgaacatcggccacgcgcaggctgccgcaggtgtgggcggggtcatcaagatggtgatggcgctgcggaatggtctgctgccgcggacgttgcatgtggatgagccgtcgccgcatgtggactggtccgcgggggcggtgcagctgctgacggagacggtgccctggcccggcggggaggggcggctgcggcgggcaggagtgtcatcgttcggcgtcagcggcaccaacgcccacgtcatcctcgaagaagcacccgcccacaacatcccgtcagacacacccgccgacgacgccccgggagaagcagccgccgacgatgttccgggggaagcggccggcgacgacgccggtaccggcggggaagcgactggtcctgctgccggcagtccaggggtgtggccgtggctggtgtcggccaagtcgcagccggccctgcgcgcccaggcccaggccctgcacgcccacctcaccgaccaccccggcctcgacctcgccgacgtcgggtacaccctcgcccacgcccgcgccgtgttcgaccaccgcgccaccctcatcgccgccgaccgcgacaccttcctgcaagcactccaggcactcgccgcaggcgaaccccaccccgccgtcatccacagcagcgccccaggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaggaccccaacacccaggacaccaccaccctcgaagaagcggccgcactgctccagcagaccccgtacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccccaccacatcacccaccacctcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaaaacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgactacgccaccaccacccaaaccctccaccaacacggcgtcaccacctacatcgaactcggacccgacaacaccctcaccaccctcacccaccacaacctccccaacacccccaccaccaccctcaccctcacccacccccaccaccacccccaaacccacctcctcaccaacctcgccaaaaccaccaccacctggcacccccaccactacacccaccaccacaaccaaccccacacccacacccacctcgacctccccacctaccccttccaacaccagcactactggctcgaaagcacacagccgggtgccggatccggttcgggttccggttccgggcgggcagggactgcgggcgggacggcagaggtggagtcgcggttctgggacgcggtggcccgccaggacctggaaacggtcgcgaccacgctcgccgtgcccccctccgccggcctggacacggtggtgcccgcactctccgcctggcaccgccaccaacacgaccaagcccgcatcaacacctggacctaccaggaaacctggaaacccctcaccctccccaccacccaccaaccccaccaaacctggctcatcgccatccccgaaacccagacccaccacccccacatcaccaacatcctcaccaacctccaccaccacggcatcacccccatccccctcaccctcaaccacacccacaccaacccccaacacctccaccacacccgacaacaagcccaaaaccacaccaccggacccatcaccggcctgctctccctcctcgccctcgacgaaacaccccacccccaccacccccacacacccaccggcaccctcctcaacctcaccctcacccaaacccacacccaaacccacccaccaacccccctctggtacgccaccaccaacgccaccaccacccaccccaacgaccccctcacacaccccacccaagcccaaacctggggactcgcccgcaccaccctcctcgaacaccccacccacaccgccggaatcatcgacctccccaccacccccaccccccacaccctccaccacctcacccaaaccctcacccaaccccaccaccaaacccaactcgccatccgcaccaccggcacccacacccgccgcctcacccccaccaccctcacccccacacaccaaccacccacccccaccccccacggaaccaccctcatcaccggcggaaccggcgccctcgccacccacctcacccaccacctcaccacccaccaacccacccaacacctcctcctcaccagccgaaccggcccccacaccccccacgcacaacacctcaccacccaactccaacaaaaaggcatccacctcaccatcaccacctgcgacaccagcaacccagaccaactccaacaactcctcaacaccatccccccacaacaccccctcaccaccgtcatccacaccgcaggcatcctcgacgacgccaccctcaccaacctcacccccacccaactcaacaacgtcctccgcgccaaagcccacagcgcccacctcctccaccaactcacccaacacacccccctcaacgccttcgtcctctactcctccgccgccgccaccttcggcgcacccggccaagccaactacgccgcagccaacgcctacctcgacgccctcgcccaccaccgccacacccaccacctccccgccaccagcatcgcctggggcacctggcaaggaaacggactggcgactggtcaagtcagcgaacatctccgccgccgcgggatgttcgccatgccgcccgagttggcggtcacagctgttgacggcgcgatcgcgagcgggcgcccgagtctcctcgtcgccgatatcgactggaagaaattgggaccggttctctccagcaagtcgtcggtcttgctcgaggaccttccccaggcacagggaactgaggaggcgcgcagtaccgttgagcagacggagagcacaaacctccggcaactcctcatgggtcggtcacgttccgagcaggaagaagagctgctcagcctcgtccgcatccactccgcggcagtgctcgggcgcgacgactccgaggccatcccgcccggtcggctgttcagggatctagggttcgactcgcttgcggcggtggagcttcgcaaccacctcgcagcacagacggagctggctctgccgacgactctcgtcttcgattaccccagccccaccaagctcgcccaatttctgctctccgagatcgcggagttccagcccgacaactcaactccgcttccgcgaccccgggcagagctcgatgagccgatcgccatcgttggcatggcctgtcgcttccccggcggagtgacctcggcggacgacttctgggatctgatctcctccgagcaggacgcgatcggcggattccccaccgaccgcggctgggacctggacacgctctacgaccccgaccccgaccaccccggcacctgctacacccgaaacggcggattcctctacgacgcaggccacttcgacgccgaattcttcggcatcagcccccgcgaagccctcgccatggacccccagcaacgactcctcctcgaaaccgcctgggaaaccatcgaacacgccggcatcaacccccacaccctccacggcacccccaccggagtcttcaccggcaccaacggacaggaccacgcggcacacatccgtcaggccccgagcggtaccgagggattcgtcctgaccggggcagccaccagcatcgcctccggccgaatctcctacatcctcgggttggaagggcctgcggtcaccctcgacacagcgtgttcctcctcgctcgtcgccctgcacctcgcctgccagtccctcaggtccggtgaatgcaccatggccttggccggcggggccacggtcatgaccaccccgatcaccttcaccgaattcgcccgccaacgcggactcgcccccgacgggcgttgcaaggcgttctcggcggcggctgacggtaccggctggggtgagggtgtggggatgctgctggtggagcggctctccgacgcccgccgcaacggtcaccgtgtcctggccgtggtgcgtggcagtgcggtcaaccaggacggtgcgagcaacggtctgaccgcgcccaacgggccctcccagcagcgcgtcatccgccaggccctcgccaacgcggacctgacccccgccgacgtcgatgcggtggaggcccacggcaccggcaccactttgggcgacccgatcgaggcccaggccatcctcgcgacctacggacaggaccgtcccggcaacgggccgttgtggctgggctccgtcaagtccaacgtcggacacacacaggccgcggcgggcgtggccggagtgatcaagatggtgatggccctccgccaccggacactcccaccgactctccacgcggatgagccgtcgccgcatgtggactggtccgcgggtgcggtgcagctgctgacggagacggtgccctggcccggcggggaggggcggccgcggcgggcaggagtgtcatcattcggcgtcagcggcaccaacgcccacgtcatcctcgaagaagcacccgccgacgacgttccggggggaccacccgccgacgaggatgccggtagtggcgaggaggctgctgccggcagtcctggggtgtggccgtggctggtgtcggccaagtcgcagccggccctgcgcgcccaggcccaggccctgcacgcccacctcaccgaccaccccggcctcgacctcgccgacgtcggatacaccctcgcccacgcccgcgccgtgttcgaccaccgcgccaccctcatcgccgccgaccgcgacaccttcctgcaagcactccaggcactcgccgcaggcgaaccccaccccgccgtcatccacagcagcgccccaggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaaaacgacaacgacaacgacaacgaggacgcggccgcactgctccagcagaccccgtacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccacaccacatcacccaccacctcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaccacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgactacgccaccaccacccaaaccctccaccaacacggcgtcaccacctacatcgaactcggacccgacaacaccctcaccaccctcacccaccacaacctccccaacacccccaccaccaccctcaccctcacccacccccaccaccacccccaaacccacctcctcaccaacctcgccaaaaccaccaccacctggcacccccaccactacacccaccaccacaaccaaccccacacccacacccacctcgacctccccacctaccccttccaacaccaccactactggctcgaactacccagcgcccaaaccagccccggtcaaaggcgttctcgccgctcggctccagacaccgccgagtcggagttctgggacgcggtgaacgaggaagacctccagagcctcgccgaaaccctcgacatcgacgcctctgctctggacacggtggtgcccgcactctccgcctggcaccgccaccaacacgaccaagcccgcatcaacacctggacctaccaggaaacctggaaacccctcaccctccccaccacccaccaaccccaccaaacctggctcatcgccatccccgaaacccagacccaccacccccacatcaccaacatcctcaccaacctccaccaccacggcatcacccccatccccctcactgtcaaccacacccacaccaacccccaacacctccaccacaccctccaccacacccgacaacaagcccaaaaccacaccaccggacccatcaccggcctgctctccctcctcgccctcgacgaaacaccccacccccaccacccccacacacccaccggcaccctcctcaacctcaccctcccccaaacccacacccaaacccacccaccaacccccctctggtacgccaccaccaacgccaccaccacccaccccaacgaccccctcacacaccccacccaagcccaaacctggggactcgcccgcaccaccctcctcgaacaccccacccacaccgccggaatcatcgacctccccaccacccccaccccccacaccctccaccacctcacccaaaccctcacccaaccccaccaccaaacccaactcgccatccgcaccaccggcacccacacccgccgcctcacccccaccaccctcacccccacacaccaaccacccacccccaccccccacggaaccaccctcatcaccggcggaaccggcgccctcgccacccacctcacccaccacctcaccacccaccaacccacccaacacctcctcctcaccagccgaaccggcccccacaccccccacgcacaacacctcaccacccaactccaacaaaaaggcatccacctcaccatcaccacctgcgacaccagcaacccagaccaactccaacaactcctcaacaccatccccccacaacaccccctcaccaccgtcatccacaccgcaggcgtcaatctcttcgcccccgtgtcggaaaccgatgccgaatccttctcttccgttacggcagcgaaggcaacgggcgcggcgattctgcatgagttgctgctggaccatgaaacgcttgaacacttcattctcttctcgtcgggcgccggcgcttggggcagcgggaatcagtgcgcatactcggcggccaacgcatacctggacgcgctcgcgacgcatcgtcagacacatggacttcccggggcatcgatcgcctggggcccctgggccggaaagggcatgtcggccggtgatgcggctcatggttacctggaaaagcgcggcattctgccgatggagccacgcatggcgctcgcggcattccatcgtgcgcgggcgcagcggccgaattccaacctgatcatcgcggacatcgactgggagcgcttcgtccccgccttcaccgctcgacgccacagcccgctcatcgaggacattccggaggttcggcaagcggctcaggagctggaagcagctgcgtcgacggcaaagacgaccacagctcagccgattgcgacgtctctccgtgagcgattggcccgactgacgtcctcaaagcagaaccaggtgctgctcggcctgattcggacaggcatctgcaccgttctcggccttcgtaatccggaaggcatcgaggaccaacgagccttccgcgacctcggcttcgactcgctgacgtcggctcagttcagcaaggaactcgccaaggaaaccggactgccactccccccgtccctggtcttcgactatcccaccccgcaggaatgtgctgcccatctgcgcacacaactcgtcgacctagacgacgaagaggacgcggcactgtcgaatgctctcccgcaagtggcccatcggcgtaccgtcgaggacgaaccgatcgccatcatcggtatggcatgtcgcttccccggcggcgtacgttctgccgacgacctgtgggaattgctcgcttcgggtaaggacgctatcggcgtcttcccgaccgaccgcggctgggacctggacacgctctacgaccccgaccccgaccaccccggcacctgctacacccgaaacggcggattcctctacggcgcaggccacttcgacgccgaattcttcggcatcagcccccgcgaagccctcgccatggacccccagcaacgactcctcctcgaaaccgcctgggaaaccatcgaacacgccggcatcaacccccacaccctccacggcacccccaccggagtcttcgccggaatcaacgctcaagaccacgccgcgcatatccgccaaagccgtgatgtggagaccatcgagggctacgccctgaccggcagttcgggaagtgtggcgtccggccgggtggcctacacgctcgggctcgaaggccccgcggtgtcggtggatacggcgtgttcgtcgtcgttggtggcgttgcattgggcggcgcaggcgttgcgtgcgggtgagtgttcgatggcgcttgccgggggtgtgacggtgatgtcgtctccgggtacgtttgtggagttctcacgtcagcggggtctggccgcggacgggcggtgcaaggcctattcggcggctgctgacggtaccggctgggccgagggtgtggggatgctgctggtggagcggctctccgacgcccgtcgcaacggtcaccgtgtcctggccgtggtgcgtggcagtgcggtcaaccaggacggtgcgagcaacggtctgaccgcgcccaacgggccctcccagcagcgtgtcatccgtcaggccctggccaatgcgggactgaccccggccgatgtcgacgcagtggagggccacggcaccgggaccactctgggggacccgatcgaggcccaggcactcctggccgcctacggacaacaccgcccccaccaccgccccttgtggctgggatccctcaaatccaacatcgggcacgcacaggccgccgcgggcgtgggcggagtcatcaagatggtgatggccctgcgcaacgggctgctgccacagaccctccacgtggacgagcccaccccccaggtcgactggtccacaggcgcagtacaactcctgacacaaccggtgccctggcccgccgacccggccggccggccacgccacgccggcgtgtcatcattcggcgtcagcggcaccaacgcccacatcatcctcgaagaagcacccactccccaggacagcgataccgacgacgaaccgcctgccaacgcaccagccctgccccatcccctccctcttcccgtgccggtgtcggcgaggtctgaggccgggttgcgggcgcaggcacaggcgttgcgccagtacgtggcagcccgcccggacatgtcacctgccgacattggtgcgggtctggcccgcggccgggccgtactggaacaccgcgccgtcatcctggccgcggaccgcgaggaactggcgcaggcactgacagccctggcagccggcgaaccccacccccacatcaccacaggccacacccggggcggtgaccgcggcggcgtcgtcttcgtcttccccggacagggcggccagtgggccgggatgggcctgaccctgctcacctcctcacccgtgttcgccgaacacatcgacgcatgcgagaaagccctcaccccctgggtgccctggtccctgaccgacatcctgcaccgcgaccccgacgaccccgcatggcaacaagccgacgtggtccagcccgtgctcttcagcatcatggtctccctcgccgccctgtggcgctcctacggcatcgaacccgacgcggtcctcggccactcccagggagaaatcgccgccgcccacatctgcggcgcactcagcctgaaagacgccgccaaaaccgttgcactgcgcagccgcgcactggccgccgtacgaggccggggcgccatggcctcactgcccctgcccgcccaggacgtgcagcagctcatttccgaacggtgggaagggcagttgtgggtggcagccctcaacggcccccactccaccaccgtctccggcgacaccaaggcggtggatgaggtgctggcgcactgcaccgacaccggcctacgggccaaacgcatccccgtcgactacgcctcccactgcccccacgtccaacccctccacgacgaactcctgcacctgctgggagacatcaccccccagccgtccaccgtgccgttcttctccaccgtggaaggcacctggctggacaccacaaccctggacgccgcctactggtaccgcaacctccaccagcccgtccgcttcagccacgccatccagaccctgaccgacgacggacaccgcgccttcatcgaaatcagcccccaccccaccctcgtccccgccatcgaagacaccaccgaaaacaccaccgaaaacatcaccgcgaccggcagcctccgccgcggcgacaacgacacccaccgcttcctcaccgccctcgcccacacccacaccaccggcatcggcacacccaccacctggcaccaccactacacccaaacccacccccaccccaacccccacacccacctcgacctgcccacctaccccttccaacaccagcactactggctccaaccacccaccacaacaaccgacctcaccaccaccggcctcacccccacccaccaccccctcctcaccgccacactcaccctcgccgacaacaacacacaactactcaccggccgcctctccctacgcacccacccctggctcaccgaccacaccgtcgccggcatggtcctcctgccgggcaccgcgctcctcgaactcgccctccaagccggcgaacgggtggactgccctcgggtggaggaactgaccctgcacgcaccgttggtgatcccgcacaccgaggacgtgacgttgcaggtcaccgttcgggcagccgatgagagtggccatcgcgccctcgcgatccactcgtactccggcaccgcgtcgtcggcggaccgggagtggacccgtcacgccacgggcctcctcacacaccacgccgacaccgatcaccgtgccgacacgcacacggacgcgtgccttggcgggagctggcccccgcccggcgcgcagcccatcgaactgggcgacgtctacggtcgtatggcggcggactcggacatcgcctacgggccggtcttccaggggctgcacgccgcctggaggttcggcgacgatgtcctggccgaggtgcgtctgccggaagaggctctgcgcgatgctccggcggcggccttcggtgttcacccggccttgctcgacgcggccctgcacgccacggcgctcaccccccagaacggggacggctcgacggagaacgtcgcccaggagagcatgcctgaccgcgcagcccaccaggcgcgactgccgttcagctggagcggcgtgtccctgcacacggcgggcagttccgtgttgcgcgtacggctgtcgcgcagtccgcagcacggtaatgccgtggccctcaccgcggccgacgaggacggtcggccggtggtgacgatcgagtcgctcgcgctgcggccggtgtccaccgaggagctgcgcgcggccgcggatcgtacgcccgagcacgagtcgctcttccgactggactgggtttccgtaccagtgcccgccaacgccccttcgcccaccgcggaccggccctgggcggtcatcggcgcgggccttccccacctgcccggcctgacggagcacgagcacgtgaccgcgtatgacgagccggcggacctgcttctggctctggaccgcggtgctccgccgcccggtgtgctggtcgtaggtggtgtcgcccacaccgaagcccgggagtattccgccgaagcccccggggagcgcgggaccgaggcctgcgaggcccggccggacgtcgtgcacgtgggcgtcgtgcacacggctgccgtgcacgcggctgccgcgcagatgttggccaggctccaggcctggctgggcgacgagcgcctcgcagacagccggctgctcgtcctgacgtgcggcgcggtcgcccgcgcctccggcgacgatgcgacggacctgcccggggccgccgtgtgggggctggtgcgttcggcgcagtccgagcacccggaccgcatcacgctgctggacttcgagcggggcacagaggcggagcccggtcagctggcgacggcgctgaactgcggggagcggcagcttgccgtccgccccggagggctgttcacgccacggctggtgcgcgcgccacgtgtcgccgacgccgtacccgccgtacccgccgtggccgtaccgtcagcgggtcacgcagccgtaccggcagcgggtcccttccttccgggcggaacggtgctgatcaccggcggaaccggtgtcctgggccggctcgtggcccggcatctggtggaggcgcacggcgtacggcatctgttgctggcgggtcggcgcggaccggacgccgagggtgcgccggagttgcgggcggagctcggtgggctcggcgcgacggtggaggtcgtcgcctgcgacgcggcggaccggcagcagctggccgacctgctgacacggatccccgacgatcggccgctgaccggtgtcgtgcacagtgcgggcatcctggacgacggcgtgatcacgtcgctgtcgccggagcggctcggggccgtcctccgggccaaggcggacgctgcgctgcttctcgacgagctgacgcgcggggcagagctgtcggctttcgtcatgttctcctccgcgtcggcggtggtcggctcgcccgggcagggcaactacgccgccgccaacgccgtcctcgacttccttgctcatcgccgccgcgccgaggggctgcccgccgtctctctcgcctggggcctgtgggaagagggcacagggatgacgggccacctcgacgtcgacgaccatgcgcggatcagccgcgcgggaatgcggccgctgccgactgccgaggctctggcgctgttcgacgcggccttggccgacggcgagccgttcctgatgccggctcggctcgacctcacggccgtacggtctggtgccgcgtccgcaccggtgccgccgctgctgcaaggtctgcttcagctgcctcggtcccgctcggccgccgcggcccccggccatggggccccggcggcggacgaggcggcggcctggcgtgagcgtctggcccggcagagtgccggtgagcgcaggcaggcgctgctgcgcctggtgcggtcgcatgtcgcggcggtgctcggccatagcggtgccgacggaatcgacgcatcgcgggcgttccgcgagctggggttcgactcgctcacggcggtcgagctgcgcaaccgtctcacggccgcgacgggcctgcggctgcgggccacgctggccttcgatttcccgaccccggcagcgctggccgagcacttgggcgagcgtctgcttcccgaccaggaggccacgggcgagcaagccggcgatcagctctccggcggcagcgaggaggacgtacgcagcctcctgacgtccattccgatcggcaggctgcgggacgcggggctcctcgggcccctgctcacgctcgcggacacgggccgcggcgcctcgggcgccgccgcaggtccggaggacgcgccgccctccggccaggacacaccggctcccgtctcgatcgacgagatggacatcgacgacctgatggatctggcgcacgggcatggcaccgcacccgcccgtgagcccgccgacgcagaggactcgtcgtcatcacgaaaccggacacaccacacacacgaaggtgagacagcgtgaacccatccgagccgctcggcctgcccaacgaacgtgtagtagacacccgaccgtccgatgccacgctctcacccgaggccggcctgaacaggtcaggagcgctgccccgtgaactgctgtcgttgccggtggtggtgtgggccggggtcggcctgctgtttctggccctgcaggcgtacgtgttcagccgctgggcggccgacggtggctaccggctgatcgagacggcgggccagggtcagggcggcagcaaggatacggggactaccgatgtggtctatcccgtgatttccgtcgtctgcatcaccgccgcggcggcgtggctcttccggaggtgccgtgtcgaacgacggctgctgttcgacgcccttctcttcctcgggctgctgttcgcgagctggcagagcccgctcatgaactggttccattccgttctcgtctccaacgcgagtgtgtggggcgcggtgggttcctggggtccgtatgtgcccggctggcagggggcgggcccgggtgcggaggcggaaatgccgctggcgtcggcctccgtctgcatgtcggctctgatcgtcaccgtgctgtgcagcaaggcactggggtggatcaaggcccgccggccggcatggcggacctggcggctggtcctggccgtgttcttcatcggcatcgtgctcggtctgtccgagccgctgccgtccgcctccgggatcagcgtatgggccagagcgctgcccgaggtgaccttgtggagtggcgagtggtaccagttccccgtgtatcaggcggtcggttccggcctggtctgctgcatgctgggctcgctgcgcttcttccgcgacgaacgcgatgagtcgtgggtggaacggggagcctggcggttgccgcaacgggcagcgaactgggcgcgtttcctcgccgtggtcggtggggtgaatgccgtgatgttcctctacacctgtttccatatcctcctgtccctcgtcggtggacagccgcccgaccaactgccggactccttccaagcgccggccgcttactgagttcagggcaggtcggaggagacggagaaggggaggcgaccggagttccggtcacctcccctttgtgcatgggtggacggggatcacgctcccatggcggcgggctcctccagacgcaccacactcctcggttcagcgatcatgcggagtcggttggggaagacgtgagtggccttcgtcttgggccggacctcgtcgcccggaagggcgtgtagtcgccagtgggaggcgacgaccgcgaccgtaacggccgtctcgagaagggcgaagttgtcgccgatgcatttgtaggtgccgagcgcgaagggcacccacgcccccttgggaactccgcggctcgatcccttggtttcccagcggccggggtcgagacgttcgggttcggggtaccaacgtgggtcgcgctggatggcgtacgcgctgtacatgacctccacatcggcgggcaggtcgtgaccgccgagtcgtacgggccgcaccgtccggcgggaccccacccagccggggtatttgcgcagtgcctctttcacgaggttctgtgtgtacggcagccgcgggaggtcctcgtgcgtgggcaaccgcccgcccaggaccgtgtcgagctctgcgtgcagccgactctcgatctcggcgttctgtccgagctcgtggaaaatccacgccgtaatggcagctgggccgccgatcccggccaccgcgattcccatgacctcgtcatggacctcctggtccgtcatggaggcaccttcggcgtccgtcgcgcgcagcatcgtcgagagcaggtcaccgtggtcgcggccatcggcgcgatacgccgtgatcgcctcccggatcgttgcgctcgtacggcccacggaccgcttgcccgcggtgggaagaacctcgtaaagggtgggggcgagagcactcagccgggccaccttcagaatgtcgtgtccggttttccgcagcgccgcctcggccttcgcgcccaggtcggagaagaacagcgtcttcgtgatcatggcaagcgacaggtcgcaggcggcctgctcaacgtccaccacctgcccagcgctccaggaatcagcggtctcctgcgcggcggccgccatggtggcgacatagctctcgaggcgctggcggtggaaccctggctgcatccgcctccgctgtcgccggtgcgtctcccccgatacggctacgaggatggggccgatgaagcggctcgcgccctgtgcgcccttgctccgggtgaaatcgcccgatccggaggagaccagcatggtccgcaccaggtccgggtgcgtggcgaggtaggcggttttcggcccgaggcggagcttgagcaggtctccgtgatctgctgcggagcgaaggaactccaggggctgccgcatcaacggcggcacatggccgacgaccggccaggcgccgggcgcctcgggaatgctgctcgtcgactgggacatcacgagtgctcctttgcggggtgaaggggggtggctgggaggggaacgacagtgacgagtgaagggggaggtgtgggggttggcgtcggcccgggggtgagcgtggacatgggagtgggagggagtgaagtgagctcggagtggtttctgggcttcattgagattcgaatccgacttccctgtcgatgagagcgaacatctcctcgtccgatgtctctgcgaggtcgggggcggtgtcgtcgccgttcaacttctgggcgagggaatgcagtcgggaggccagccgcgtgcgcgcgccgtcgtccagcggggcagcggaggatgtggtggaggagagcactaccgcctccagccgctcgagctccgagagcagcgagggcagccccgggggtgtcgttgcggcgtccggctcggccgcggcggtgagtcccttgctgacgagttgtgtgtggaggtggtgggtgagggtggtggggttggggtggtcgaaggcgagggtggtggggaggcggagtccggtggtgtgggagagccggttgcgtagttcgacggcggtgagggagtcgaagccgaggtcgcggaacgcgcggtcgggggggatggtgtcgggggtggtgtggcccaggacggtggcgatgtgggagcggaccagggcgaggagggtggtgtgctgttgttcgtgtgtctggccggccagccggccgtgcagctgggcgccgttgtccgcaccaccggtagtggtggtgcgggtggtgcggcggcgggtggcgggcaggaggtcctgcagcaggggcggcaggggcggggcgggacgcaggtcggcgggcagcaggaccggccggtccagagccagggccgcatcgaagagggccagtgcgtccggggtcgacatgggatgcagaccggaacggatgatgcgccggtggtcggtgccggccagatgcccggtcatcccgctggcctcttcccacagcccccacgccagcgacacccccggcagacccgccgcccgccgccggtacgccagcgcgtccagagcggcattggccgcggcgtagttgccctgcccggccgaccccaggatccccgcggccgaggagaacagcacgaacgccgacagctccataccccgcgtcagctcatccagcaaaagagcggcatccaccttggccgcgaacaccgtgcccagccgctcgggcgtgagagaggcgatcgtcgcatcgtccagcacaccagccgcatgcacgacacccgtcagcggacacccggcaggaacaccctccagcagccggaccacctcccgccgctcccccacatcacacgcaacaatccgcacctccgcccccaacgcggccagctccgcccgcaaaccctccgcacccggagcatccggaccacgccggctcaccaacaacagatcccgcaccccacacacaccagccagatgccgcgccaccgccgcacccagcacacccgtcccacccgtcaccaacaccgacccacccgacaaccacggcaacacctcccgacccgatacatcaaccggcgactcaagtcgtgtcaggcgtgcggccagcacccgctcaccacgcaccgccaactgcggctcaccacacgccaccaccgcagccacacgcccaccatccagaccagaccccataccggcctcgttgccggcatcgcggtcagcgccgctgtcgaggtcggtgtccaggtcgaggaggacaaaccggtccggatgctcagcctgcgccgaccgcaccagcccccacaccgccgcacccaccacatccaccgggccatccaccgggccgtcctccgggccggccaccaccgcaccccgggtcaccaccaccagccgcgaacccgcaaaccgctccagccccagccacccctgcaccacacccaacaccccaccaacaacctcacccacaccaccgccaccaccgccgccatcggcaccggcatccgggcaccgcaacaccaccacccccggcacaccatcctcctcagccgccagaccaacgaggtcgtcggcaccatccagcaccaccaccgatgccccgcccgacaccagtacatctgagggcacctcaacccacttcatgtcgaagagctcagcgcgctgtacggcgcgctcggcagctcgcaattcgtccgccgccaacgggcgcaccgccaacgcctcgacggacgccacgggcgtaccggtgtcatccgtgaccagcacggaaactgcggcgtggccgctgttcggatcggccggcgagagtcgcacgcgcaacgacgacgcattggcggcgtgcagcgtcacaccggtgaaggagaacggtacggatccctgcggcagactgcccgacggcgcaaaggccgctgcgtgcaaggcagcatccagcagtgccgggtgcaggttgtacgcggatgcctcgccgtgcacctgttctggaaggcgaacctcggcaaacacctcgtctcccagacgccaggcagcagtcagcccccggaatgcggggccatagacaaagccatttgcctcgtagtcgccatacaaggctgccaattcctcatcagcacagcgaactgcgcccgctggcggccacatcgacagatcatcgtggctacggcctgtctcaatgcgcgaggtcttggttcccagaacggccgtggcgtgatgacgccagggagccgctgcgggggcgttctcgcttcgcgagtagatcgtcagtgaacgagtgtcggtgtcgtccggtggattgatgtgcacctgaacgtcgacggcaccctcacgggggatgacgagaggcgtgtggagggcgagttcttcgaggtggtcggtcgtggttgcttggagggcgagttcgaggagggcggttcctggcacaagagtggtaccgacgacggtgtggtcggtgagccaggggtgggtgcgtagggagaggcggccggtgagtagttgtgtgttgttgttggcgagggtgagtgttgcggtgaggagggggtggtgggtgggggtgaggccggtggtggtgaggtcggttgtcgtggtgggtggttggagccagtagtgctggtgttggaaggggtaggtgggcaggtcgaggtggtggttgtgggggtgggggtgggtttgggtgtagtggtggtgccaggtggtgggtgtccgaatgccggtggtgtgggtgtgggcgagggcggtgaggaagcggtgggtgtcgttgtcgccgcggcggaggctgccggtcgcggtgatgttttcggtggtgttttcggtggtgtcttcgatggcggggacgagggtggggtggggactgatttcgatgaaggggcggtgtccgtcgtcggtcagggtctggatggcgtggctgaagcggacgggctggtggaggttgcggtaccagtaggcggcgtccagggttgtggtgtaccagaccaggtgccctacgacggtggagaagaacggcatggtggacggctggggggtgatgtctcccagcaggtgcaggagttcgtcgtggaggggttggacgtgggggcagtgggaggcgtagtcgacggggatgcgtttggcccgtaggccggtgtcggcacagtgggtgaggagttcttctactgcggtggtgtcgccggagacggtggtggagtgggggccgttgagggctgccacccacaactgcccttcccaccgttcggaaatgagctgctgcacgtcctgggcgggcaggggcagtgagaccatggcgccccggcctcgtacggcggccagtgcctggctgcgcagtgcaacggttttggcggcgtctttcaggctgagtgcgccgcagatgtgggcggcggcgatttctccctgggagtggccgaggaccgcgtcgggttcgatgccgtaggagcgccacagggcggcgagggagaccatgatgctgaagagcacgggctggaccacgtcggcttgttgccatgcggggtcgtcggggtcgcggtgcaggatgtcggtcagggaccagggcacccagggggtgagggctttctcgcatgcgtcgatgtgttcggcgaacacgggtgaggaggtgagcagggtcaggcccatcccggcccactggccgccctgtccggggaagacgaagacgacgccgccgcggtcactgccccgggtgtggcctgtggtgatgtgggggtggggttcgccggctgccagggctgtcagtgcctgcgccagttcctcgcggtccgcggccaggatgacggcgcggtgttccagtacggcccggccgcgggccagacccgcaccgatgtcggcaggtgacatgtccgggcgggctgccacgtactggcgcaacgcctgtgcctgcgcccgcaacccggcctcagacctcgccgacaccggcaccggcaccggcaccggctcagactcagccaccggaagggctggattcggagcacccaccgacaccccaccaccggcagcaccgcccgccgccgcaggcgcctcctccaaaatcacatgggcgttggtgccgctgacgccgaatgatgacacgccggcgtggcgtggccggccggccgggtcggcgggccagggcaccggttgtgtcaggagttgtactgcgcctgtggaccagtcgacctggggggtgggctcgtccacgtggagggtctgtggcagcagcccgttgcgcagggccatcaccatcttgatgactccgcccacgcccgcggcggcctgtgcgtgcccgatgttggatttgagggatcccagccacaaggggcggtggtgggggcggtgttgtccgtaggcggccaggagtgcctgggcctcgatcgggtcccccagagtggtcccggtgccgtggccctccactgcgtcgacatcggccggggtcagtcccgcattggccagggcctgacggatgacacgctgctgggagggcccgttgggcgcggtcagaccgttgctcgcaccgtcctggttgaccgcactgccacgcaccacggccaggacacggtgaccgttgcgacgggcgtcggagagccgctccaccagcagcatccccacaccctcggcccagccggtaccgtcagcagccgccgaataggccttgcaccgcccgtccgcggccagaccccgctgacgtgagaactccacaaacgtacccggagacgacatcaccgtcacacccccggcaagcgccatcgaacactcacccgcacgcaacgcctgcgccgcccaatgcaacgccaccaacgacgacgaacacgccgtatcgacggtcacggccggaccctcaaggccaaagctgtaggccacccggccggtcgcgacgctgcctgcgctgccgttggcgatgaggccttcgaaaccctcggggacatggtggagacgcgcggcgtagtcgtggtacatcaccccggcgaagacacccgtacgggagccacgcatcgacagcggatcgatacccgcccgctcgaacgcctcccacgacgtctccagcaacaaccgctgctgcggatccatcgccaacgcctcacgcggactgatcccgaagaagtccgcatcgaactcccccgcctcatacaaaaacccgccataccgcgcgtacgacgtccccgaccggtcagggtccgaatcaaacaacccctccagatcccacccccgaccggccggaaattcaccaatcgcatccccacccgacgcaaccagctcccacaactcctccggcgaacacaccccacccggaaaacgacacgccatccccacaatcgcaatcggctcatccgcggcaacctgatgaagtgcgacctgcgatggcgtctcgccttccgcgtcgtcgcccatcagctcacgacgtaggtgacgcgccagggtcgctgcattcggctggtcgaagaccagactggtcggcagtcgcagtcccgttgcctcacccaggcggttacggagttccaccgctgtcaaggagtcgaagcctaggtcgcggaacgccgagtcaacggggatcatctccggcgcgttgtggccgaggacggtggcgatgtgggagcggaccagggcgaggagggtggtgtgctgttgttcgtgtgtctggccggccagccgggcatgcagctgggcgccgttgtccgcaccaccggtagtggtggtgcgggtggtgcggcggcgggtggcgggcaggaggtcctgcagcaggggcggcaggggcggggcgggacgcaggtcggcgggcagcaggaccggccggtccagagccagggccgcatcgaagagagccagtgcgtccggggtcgacatgggatgcagaccggaacggatgatgcgccggtggtcggtgccggccaggtgcccggtcatcccgctggcctcttcccacagcccccacgccagcgacacccccggcagacccgccgcccgccgccggtacgccagcgcgtccagagcggcattggccgcggcgtagttgccctgcccggccgaccccaggatccccgcggccgaggagaacagcacgaacgccgacagctccataccccgcgtcagctcatccagcaaaagagcggcatccaccttggccgcgaacaccgtgcccagccgctcgggcgtgagagaggcgatcgtcgcatcgtccagcacaccagccgcatgcacgacacccgtcagcggacacccggcaggaacaccctccagcagccggaccacctcccgccgctcccccacatcacacgcaacaatccgcacctccgcccccaacgcggccagctccgcccgcaaaccctccgcacccggagcatccggaccacgccggctcaccaacaacagatcccgcaccccacacacaccagccagatgccgcgccaccgccgcacccagcacacccgtcccacccgtcaccaacaccgacccacccgacaaccacggcaacacctcccgacccgatacatcaaccggcgactcaagtcgtgtcaggcgtgcggccagcacccgctcaccacgcaccgccaactgcggctcaccacacgccaccaccgcagccacacgcccaccatccagaccagaccccataccggcctcgttgccggcatcggcgtcagcgccgctgtcgaggtcggtgtccaggtcgaggaggacaaaccggtccggatgctcagcctgcgccgaccgcaccagcccccacaccgccgcacccaccacatccaccgggccgtcctccgggccggccaccaccgcaccccgggtcaccaccaccagccgcgaacccgcaaaccgctccagccccagccacccctgcaccacacccaacaccccaccaacaacctcacccacaccaccgccaccgccgccatcggcaccggcatccgggcaccgcaacaccaccacccccggcacaggcccaccaccgctctcacccacgtcctcgtgccacgcccacgcctgcccacacaccggcacaggacccacctcagcccactgcaccgcatacagcgaaccccgccgccccgccgaaaccgagacagcacgcaactgacccatatccacaggccgcaactcaagacgatcgaccgacgccaccggcaccccggtgtcgtcggtgatgcgcacgcacacggccgcccctgtcgctccaagcgtcgacaggcacgcgcgcacggagactgcaccatgcgtacggaaccgcagaccgttccacacatggggcacgacgggcgtccccggacccgccacagaaagcaggccggtgccctgaagggcagcgtcgagcagggccgggtgcagaccgtacgccgccgcgtctcccgacacttcttcgggaagacgtgcctcgacgaggatgtcgtcgccgtagcgccaggccgcgcgcaacccttggaatgccaggccataagcaaagccggcgtcggccatttgatcgtaagccgtgttcaggtcgacaggcgtagctccaacgggaggccagggtcccgcaagcagctcgtacgaggcagtgtcatcgtccttggcagggctcagcacacccgcggcatgacgcgtccacgcactggccgacgcatcggctccaccactgccgccctcaccgcgtgagtggatggtcatcatgcggcgacccgactcgtccggcgccgcaatggcaacctgaagggtcacgtctccgacctcaggaatgaccaacggtgtgtggagcgtcagctcgtccacgtggtcgcaacccacactttctccggcatgaagggccagttccgcgaaggccgtacccggcagcagcacgacaccgcctaccgcatggccggcgagccagggatgcgtgcgcaacgagaggcgccccgtcagtaggcagccgtccccttcggccagttccaatgtggcgccgagtagggggtgttcggtggggtcgagtccggctgctgacacgttgccggcaccgggctgtgtgctttcgagccagtagtggtggtgttggaaggggtaggtggggaggtcgaggtgggtgtgggtgtggggttggttgtggtggtgggtgtagtggtgggggtgccaggtggtggtggttttggcgaggttggtgaggaggtgggtttgggggtggtggtgggggtgggtgagggtgagggtggtggtgggggtgttggggaggttgtggtgggtgagggtggtgagggtgttgtcgggtccgagttcgatgtaggtggtgacgccgtgttggtggagggtttgggtggtggtggctatgtcgacggtgttgcgggcttgttgggtccagtagtggggggtgaggagttggtcgggtggggtgttggcggtgatgaggggggtgtggggtgggtggtaggtgagggtttgggtgtgctggtggagttggttgaggatggggttggtgtggggggagtggaaggcgtggttggtggggagggttttggttttgatgccttgttgttggcagagggtggtgatgtgttggacggtgtggggggtgccgctgatgacgagggaggtgggggtgttgatggcggcgatggcgaggtcgttttcgtgggcggtgatgtggtgggtgatgtggtggggggtggtgtggagggtggtcatggtgccggggggcatggtttgcatgagggtggcgcgttgggtgatgagggtggtggcgtcggtgagggtgaggatgccggcgaggtgggcggcggtgatttcgccgagggagtgtccggcgtagtagtggggggtgatgtggtagccgtcggtgaggaggcggtggagggcgacctggaaggcgaagagggcgggctgggcgtacggggtctgctggagcagtgcggccgcttcttcgagggtggtggtgtcctgggtgttggggtcctgggtgaggagggggaggagggggtggtcgaggtgggggtcgaggtgggtgcagatgtcgttgagtgcggcggcgaagacggggtgggtgtggtagaggccgtgggccatgccggggcgttgggtgccctgtccggagcagatgaatgcggtctttcctgcggcctccccggtcccggtcccgcctggggcgctgctgtggatgacggcggggtggggttcgcctgcggcgagtgcctggagtgcttgcaggaaggtgtcgcggtcggcggcgatgagggtggcgcggtggtcgaacacggcgcgggcgtgggcgagggtgtatccgacgtcggcgaggtcgaggccggggtggtcggtgaggtgggcgtgcagggcctgggcctgggcgcgcagggccggctgcgacttggccgacaccagccacggccacacccctggactgccggcagcagcctcctcgccactaccggcatcctcgccggcgggtggtccccccggaacgtcgtcggcgggtgtgtctgacgggatgttgtgggcgggtgcttcttcgaggatgacgtgggcgttggtgccgctgacgccgaatgatgacactcctgcccgccgtagccgcccctccccgccgggccagggcaccgtctccgtcagcagctgcaccgcacccgcggaccagtccacatgcggcgacggctcatccacatgcaacgtccgcggcagcagaccattccgcagcgccatcaccatcttgatcaccccggcgacgcccgcggcagcctgtgtgtgaccgacattggacttgaccgagcccagccacagcggcccctcgccggcacggtcctgcccgtaggtcgcaaggagggcctgggcctcgatcgggtcgcccaaagtggtgccggtgccgtgggcctccaccgcatcgacatcaccggccgacaagccggcgttggcgagggcctggcggatgacacgctgctgggagggcccgttgggcgcggtcagcccgttgctcgcaccgtcctggttgaccgcactgccacgcaccacggccaggacacggtgaccgttgcgacgggcgtcggagagccgctccaccagcagcatccccacaccctcaccccagccggtcccgtccgccgccgccgagaacgccttgcaatgcccgtccgcggccagaccccgctgccgcgaaaactccacgaaggcacccggagacgacatcaccgtcacacccccggcaagcgccatcgagcactcacccgcacgcaacgcctgacaggccagatgtaaagccaccaacgacgaggaacaagccgtgtccaccgacaccgcaggaccctcaaaaccaaacgtgtacgagatacgaccggaggccacactcccggatgtgccggtcaggacatagccctcggtgtcggctgcggcgttttcgtgcagcctgggtccataggcctgcggaatgaggcccgcgaacacgcctgtctggctcccgcgtacggtcgtagggtcaatacctgcctgctccatggcctcccatgaggcctccagcagcaatcgctgctgcgggtccatcgccagtgcctcacgcggactgatcccgaagaagccggcgtcgaactcccccgcgtcgtagaggaaactcccacagcgggtgtacgaggtgcccggccgacccggttccggatcgaacagtgcttccaggtcccacccacggtccgtcggaaactcgccgaccgtgtccctccccgatgcgagcagttcccacagctcctcggctgaggtgacgcctccgggatagcggcacgccatgccaatgatcgcgacgggctcgtcctggtctgcaggcacagccgcagcacggggagctgggatggaggcagtgctgtccgagcccagaagttgtgtgtggaggtggtgggtgagggtggtggggttggggtggtcgaaggcgagggtggtggggaggcggagtccggtggtgcgggagagccggttgcgtagttcgacggcggtgagggagtcgaagccgaggtcgcggaacgcgcggtcgggggggatggtgtcgggggtggtgtggccgaggacggtggcgatgtgggagcggaccagggcgaggagggtggtgtgctgttgttcgtgtgtctggccggccagccgggcatgcagctgggcgccgttgtccgcaccaccggtagtggtggtgcgggtggtgcggcggcgggtggcgggcaggaggtcctgcagcaggggcggcaggggcggggcgggacgcaggtcggcgggcagcaggaccggccggtccagagccagggccgcatcgaagagagccagtgcgtccggggtcgacatgggatgcagaccggaacggatgatgcgccggtggtcggtgccggccaggtgcccggtcatcccgctggcctcttcccacagcccccacgccagcgacacccccggcagacccgccgcccgccgccggtacgccagcgcgtccagagcggcattggccgcggcgtagttgccctgcccggccgaccccaggatccccgcggccgaggagaacagcacgaacgccgacagctccataccccgcgtcagctcatccagcaaaagagcggcatccaccttggccgcgaacaccgtgcccagccgctcgggcgtgagagaggcgatcgtcgcatcgtccagcacaccagccgcatgcacgacacccgtcagcggacacccggcaggaacaccctccagcagccggaccacctcccgccgctcccccacatcacacgcaacaatccgcacctccgcccccaacgcggccagctccgcccgcaaaccctccgcacccggagcatccggaccacgccggctcaccaacagcagatcccgcaccccacacacaccagccagatgccgcgccaccgccgcacccagcacacccgtcccacccgtcaccaacaccgacccacccgacaaccacggcaacacctcccgaccagcaacatcaccggaccgctgagcaggtacatcaacggacgactcaagtcgcgtcaggcgtgcggccagcacccgctcaccacgcaccgccaactgcggctcaccacacgccaccaccgccgccacatgcccaccatccacgccccaaccagcaccagcaccagcaccagcaccggtgtcgaggtcggtgccggtgtcggtgtcggtgtcgaggtcgaggaggacaaaccggtccggatgctcagcctgcgccgaccgcaccagcccccacaccgccgcacccaccacatccaccgggccgtcttcttggccggccaccaccgcaccccgggtcaccaccaccagccgcgaacccgcaaaccgctccagccccagccacccctgcaccacacccaacaccccaccaacaacctcacccacaccaccgccaccgccgccaccggcaccggcatccgggcaccgcaacaccaccacccccggcacaggcccaccaccgctctcacccacgtcctcgtgccacgcccacgcctgcccacacaccggcacaggacccacctcagcccactgcaccgcatacagcgaaccccgccgccccgccgaaaccgagacagcacgcaactgacccatatccacaggccgcaactcaagacgatcgaccgacgccaccggcacacccgcctcatccccgaccacgaccgacaccgcctcacgcccgccgccccgccctacagcccacacacgcacccgcacaccggtcacacccgcccggtgaagcgacacaccaccccacacagccggcacccgaacaccctccccgaaccccgccccctccccaaaccccgtcccacccggaagcaacaccgacaacggctggaccacaccatccagcaacgccggatgcagcccaaaaccagccgcatcaccccacgcctcctccggcagacacacctcagccagcaaatcccccccatcacgccacaccgcacgcagccccgaaaacaccggccccaaaacacaaccagccccagccaaacggtcacggacaccatcgacatccaccgccaccgcaccccgcggcggccacacccccgccagaccatccaccaccacaccaccaccagcagcagcctcaaccagcacccccgaggcatgacacgtccacaccccacccgacgcaccacccccaccacaagcactcccaccccgcgcatacacactcaccaaacgccgcccctccccatccgcagccgcaaccccaacctgcacactcacacccccacccacaggaaccaccagcggcgcatgcacagtgagttgctcgattcgggtgcagcccacgcgttcgccaacctggaccgccagctccacgaacgccgaccccgacagcaggaccgcaccccccacctcgtaatcgcccagccacggatgcgagcgcaaggacaggcgacccgtcagtaggcagccgtccgtgtctgcgagttggactgttgccgcgagcagagggtgttcggccggctccaagccagcagcggcgacgtcacctgctcccgtgggagcgtcgagccagtagtgctggcgttggaagggataagtggggaggtcgaggtggtggttgtgggggtgggtgtggtggtgggtgtagtggtggtgccaggtggtgggtgtgccgatgccggtggtgtgggtgtgggcgagggcggtgaggaagcggcgggtgtcgttgtcgccgcggcggaggctgccgatcgcggtgacgtcttcggcggtgtcttcggtggtgtcttcgatggcggggacgagggtggggtgggggctgacttcgacgaagacgcggtgtccgtcatccgccagggcctggacggcatcgctgaaacggacaggctggtgcaggttgcggtaccagtaggcggcgtccagggttgtggtgtccagccaggtgccctccaccgtggagaagaacggcacgccggacggctgcgggctgatgtcccccagcagctccagcaactcctcccgcaggggctgcacatgggggcagtgcgaggcatagtcgaccgggatccgccgggcccgcaccccggtgccggcacagtacgccagcacctcgtccaccgcctcggcatcccccgagacggcggtggagcgggggccgttgaccgccgccacccacaaccgccccgcccaccgctcaccaatgagctgctccacctcctgggcaggcagcggcactgaggccatgccgccccggccccgcacagcggccagcgcccggctgcgcagcgcaacagtcttcgccgcgtccttcaggctcagcgccccacacacatgcgcggccgcgatctcgccctgggaatggccaaggaccgcgtcgggttcgataccgtaggaacgccacagagcagccaaagacaccatgacgctgaacagcacaggctggaccacatcggcccgctcccacaccgcatcccccgcgtcccggcgcaggatgtccaccacagaccagtccacccacggcgccagagcctcctcgcacgcctgcatccgccgggcgaacaccggagaggaggcgagcagacgcacacccatcccggcccactgcccaccctgtccgggaaacacgaagacgacaccgccccggtcaccacccggcgcatgacccgtggtcacccgccgatccggctcacccgccgccagcgcccccaacccttgcaccagctcctcacggtccgcggccaggacgaccgcacgatgctccagcacagcccgcccacaggccagacccgcacccacatcggcaagcgaaacgtccggccggactgccacgtactgacgcaacgcctccgcctgcgcccgcaacccagcctcagacctagccgacaccggcacaggaaccggcaccggcaccggcaccggcaccgactcagccaccggcgcagacacagccactggagcggccaccgactcagccaccgaaatggcaagacccggagcaccctccaacaccccacccccggcaacacagccccccgccgccggcgcctcctccaaaatcacatgcgcattcgtgccactgaccccgaacgacgacactcccgcccgccgcaaccgccctgccgcgtcccccggccacggcaccgcctccgtcagcagccgcaccgcccccgcggaccagtccacctgcggcgacggctcatccacatgcaacgtccgcggcaacaccccctcccgcaacgccatcaccatcttgatgaccccacccacacccgcggcagcctgcgcatggccgatgttcgacttcaccgatcccagccacagcggcctgttaccggcccgctgcccgtacgtggcgagcaacgcctgcgcctcgatcggatcacccagcgtcgtgcccgtcccatgcccctccaccacatccacatccgccacggacaaccccgcgttcgccaacgcctgccggatcacccgctcctgagccggaccattcggcgccgtcaacccattcgacgcaccgtcctgattgaccgcactgccgcgcagcaccgccagcacccgatgccccagccgcaccgcatccgacaaccgctccaccaacagcatcccgacgccctcgcccatgccggtgccgtcggctccacccgcgaaggacttgcagcggccgtccaccgacagtccgcgctggcgtgagaactcgacgaagaggtgcggggtcgacatcaccgtcacaccgccggccagcgcgagcgtgcactcacccgaccgcagcgactggcacgccagatgcagcgccaccaacgacgacgaacatgccgtgtccaccgagacggcagggccctcgagaccgagcgtgtaggcgacgcggcccgacgcgacggcgccgccgctaccgttgccgatgtagccctcgaatccctcggggatggtacccaggcgggatccgtagtcgtggtacatcaccccggcgaagacacccgtacgggagccacgcatcgacagcggatcgatacccgcccgctcgaacgcctcccacgacgtctccagcaacaaccgctgctgcggatccatcgccaacgcctcacgcggactgatcccgaagaagtccgcatcgaactcccccgcctcatacaaaaacccgccataccgcgcgtacgacgtccccgaccggtcagggtccgaatcaaacaacccctccagatcccacccccgaccggccggaaattcaccaatcgcatccccacccgacgcaaccagctcccacaactcctccggcgaacacaccccacccggaaaacgacacgccatccccacaatcgcaatcggctcgctggacgcctccatggcggctgccagttgctcattacgtgcccgcagggtctggttcgccttcagagacgccctaagcgcgtcgacgagcttttcgctggacgtgtccatcactgtctcccaaattcaagaagtctcagaaaggcccgtatggccgtaagggggaaagcactgatcgatgccggagccgaccggataccaccgactggccgactggccgaccggccgaccgggctgtgcccgacccgccgatcagggccgcgatcaggaccgcgatcagaggcgcgatcagcgccgcactgatgcgatttctgtcagccattcgtcgacatgccgagcagtcgaatccgcaaactgttccagcatcgtgaagtgattcccctggatgtccagaacggtgtgcggaactccccacggcggcggcatctgttctccgtcccggccgcgcaggaagagggcgggtgtggtgatgtccggaggactccagccggagaagatgcggaagtatccgcccatggcgaccaggcgtgtgtagtccacgtccacaaactgcgtgacgcggtcgaagatttcacttgtcagcgcggacgcgacaggtgcgatgccgtcgtccgggagataggcgtccatggtcaccaccgcttccggacggacgcctagacgctccagatgactcgtcaccgcgtagacgaaccatccgcccgcggaatgcccggcgagcgcaaaaggcgcgccgtcggtgaaccggacgatcgcgtcggcgaacatgcgggtcaccgcgccgattccggacggcaggggttcgccctccaggaaccctggcgcaggaacgtaccagacgtctcggtgtccgttcagtcccgccgcgaaacgtgagtactggtacacgctcgacacggcggcgacggtgggcaggcagatgagggcgggccgtgtttcgccccgggcgagtgcttcaccttgggcgcgcgcttcaccctgggcgagccggacgaacgtcggctccgggatgtccgaggggtccgtgaaggcgggccggaagaaggaggccgccgagagcagggccatggactcctcgatgcggcgggtgtcgtgtccgatccagaacagggattcgacggtttcggtggaggtgccgcccctggtctgctgcttctcgctccccgtactgcgctgctgtccggtctcggcactccctgcgctcccggccccggctgccgcggcggcaggggccggctcgtccggcgtgcccgcctcggccgtcaggcgggtcgcgaggtgatcggcgagtgccgcggggctgggctggtcgaagatgagcgttgccgggaggcgcaggccggtgacggcgttgatccggttgcggagttcgacggcggtcagcgagtcgaagccgaggtcgcggaactcggtgtcggccgggaccagatcgtccgggagtgcgccgtccgcggctgtgacggcgctggtggggtggccgaggacggcggcggcatgggtccgtacgagttccaggaggagaccggtgcgctgcgcggggatggtgagtccggccaggcgctcgcgcagcgtggcgggggtgtcggtcgcgatgccgtggtcggcggaccgccgggccgggatgcggatcagcccgtgcaggatgcgcggcagggcgccggccgtggcctgtgcgtggagggtggccgcgtcgagccgggtggcgaggagcagcccgtcaccgaaagggccgaggcgatccgctgtgtcgaggagcgcgagtccctgtgcgttggacagggggagcaggccgccgcgggccatgcgcgcgaagtcggtgccggcgaggttgcgggtcatgccgtcggcctcgccccaaaggccccaggcgagcgaccggcccggcagtgcctgggtgtggcggtgctgcatcagggcgtccagaaaggcgttcgccgcggtgtagttgccctgtccgggactgccgaaggaggcggcggccgaggagaagacggtgaaggtggtgaggccggcgtcgcgggtcaggtcgtgcaggtgcgcggcgccgaacgccttcgcgtgcaggacggcctccatgcgctccggagtgagcgaggtgaggatgccgtcgtcgaccacaccggccgtgtggatcacggctttcagggggtgctgcgcgggcacttggtcgaggagcgcggcgacggccgcccggtccccgatgtcgcaggccgcgaccgtggcctcggcgccgaggccggcgagttcggcgaccaggtcggcggcgccgtccgcggccgtgccgcggcgggtggccagcagcaggtgccgtaccccgtgggccgtggcgagatgacgggcgacgagccggccgaggacgccggtaccgcccgtgatgaggaccgtggcctccgggtcccagtcggcgtcggtggtgctcggctgtggctgccggacgggcactcgtgtcatccgcgggatgcggacggcaccatttcgcagggcgatctgcggttccccggccagcaggggaagggcgttgcgggaggcgtcggtgtcgtcggtgtcggccagcaggaaccggtcggggttctcggtctgcacggagcggaccagtccccagacggcggcgtgtgcgaggtcggacacgggctcgtcgggggtcgcggtgaccgagccgtgcgtgaggagggccaggcggcaggccgcgagccgttcgtcggcgacccattcctggagcagggcgaggacgcgggtggtggcttgccgggtggcgtcggcgagggcggtggagtcggccggggccgagccggccggggcggaatcggtgagggcggaatcggtgagggcggaatcggtgggggcggatgcgccgtccggctcgcacgagatgacgaccatgcccggtgccggggcgccggccgccagggcttctgcgagagccgccgggtccgggtaggcctgccaggaggcgccgttgcgctccaggacggcggccgtccgccgggcaccggggccgattagggcccagtcggctgtccgtgccggtgtggtggggaggtgcagcggccgccattcgatgcggaagaggtggtcgtggtagccggtgcgcgcggcctggagctgctcggcggagacgggccggaaggcgagggaccccgcggagatgacgatgcgtcccgatgcgtcggtggccagcagtccgaccgcgtcctcgtccgtgcggacggtgagacggacgtgcagggtggaggcgccggaggcggcgaccgtgacgccggtccaggagaacggcagccagccgtgtccgtcggcggcggcatcgccctcgtggcgcagaacgaccgggtgcagtgccgcgtccagcagggccgggtgcagggcgtaccgggcggcgtcggccgcctgtccctccgtgctctcgggcagggtgacgacggcgaacacctcgtccccgcgccgccagacctcgcgcagcccctggaacaccggcccgtatcccaggccggcgccggccagctgctcgtaccagccgtccaggtccaccggtgctgcgtcggcgggcggccacggttcctgtgtgtgctcctccgcgggccgggcggtgccggtcaggacgccggtggcgtggcaggtccactcggtgccggtcgccgccgcggacgaggacgacagtccgtcgtcttcgcgggcgtacagggcgaaggtgcgccgttcgggctcctcgggcgtctgggggccctggggtgccccgacggagagttgcaggatcaccgagccctgttcgggaaggacgagcggtgtccgcagggtgagttcctcgacggtgccgcagtcgacctcgtcgcctgcgcgcacggccagttccaggatggccgtgccgggcagcaggacggtaccgaagatggcgtggtcggccagccacgggtgtgtgcgcagggagagacggccggtgaagaggagttcctgcgactcggccagtgccaccgcggaaccgagcaggggatgcccggcggtgccgagccccgctgccgacaggtcccccgggtggccggccgaggtgtcgacccagtagcggtggtgatcgaaggcgtaggtcggcaggtcgaggtggcgggctcgatcgcgttcgggcagggcggcgggccagttgaccgccgccgctccgtgcgtatgcagccgggccaagccggtgagcagggtgccgggttccgggctgtccggccgtaggagcgggatgagcaggttctcttgcggggtgccggtgtcgtcgtcggcggggtggctgtcggcggtggcctctaggcattcctcggccagtgccgacagggtcccgtctgggcccagttccatgaaggtgcggactccgtcggtgtgcaggcggctgatcgcgtcgccgaagcgcacggtccgccgtacctgccggacccagtactcggggtcgctcagttctcccgccgccacgatgtcgccggtgagcgtcgacaccatgggaatggctggttcgctgtaggtcagcgaggccgcgacctgctggaactcctccagcatcgggtccatcagcggtgagtggaaggcatgcccggttcgcaggcgcttgactctccgcccgcgctcggcgaaccagtccgccatgttccccacctcgtcctcggcgccggagaacaccaccgaggcgggtccgttcacggccgcgaccgacacccgggcttcccggccgtcgagcgcctgtcgcgcctcggcttcgctcgcccgtacggcgaccatggcgccgcctggtgcgagctgctccatcaggcgcccgcgggccgccaccaggcggcaggctgctgccaggggaagcaccccggcgacgtgggcggccgcgagctcgccgatcgagtgcccggccacgaagtccgcgcgcacgccgagacgttccaggtgccggaagagcgcgacctggacggcgaacagcgccggctgggcgtaccgcgtacggtccagaacatccgcggcatccgcgacatccgcaagatccgcactggcgtggatcagcgggcgcaggggctggtccaggtgaccgtccagttccgccagtacctggtccagcgcgtccgcgtaggccgggtgagccgcatacagctgacggcccattcccacgcgttgcgtgccctgtccggcgaacagcatggcggtctttccgcgccggcggcctgagtggccgccacgcgggccgaccgacccttcgatcaggccgtccgccgaccggccctcggccagcgcgtcgagggcctgaaggaagccgtcgcggtcctcggccacgacgacggcccggtgatcgaacacggaccgctgtgccgccagggcgtgcgccacgtcggccggccgggcatcggatgccctggcagcgaactgccgcaaccgtcgcgcctggccccgcagcgctcgctcggacttggcggagagcagccacgggatgggcaggagggccggcttgtcggacatggcgtcggcgacgcactccggttcagccgacttgtcggacacggcctcggcgacgcactcagccgacatctcggacatggcgtcggcgacgcactccggttcagccgacatctcggtcacggcgtcagcgacgcactccggttcagccgcctcctcttgcggctcggtgaggtccgccggtccggtggcgtcgaccacgtggggcgcctcgaccggcgcctgctcgacgatgacgtgcgcctcagccggtaccggctcactgatgacgtgcgcctcgaccggcgcctgctcgatgatgacgtgggcgttggtcccgctgactccgaacgcggagacgcccgcgcgcctgggccggccgttctgctgccacggtacgggctcggtgagaagccggacgccgccgctcgaccagtcgatgtggggggagggttcgtcgatgtgcaggctggtcggcaacagttcgtggttcagggccatgaccatcttgatcacaccggccacacccgcggcagcctgcgcatgcccgatgttcgacttcaccgaccccaaccacaccggccgctcccccgaacgaccctgcccgtacgtggcgagcaacgcctgcgcctcgatcggatcacccaacgtcgtacccgtcccgtgcccctccaccacatccacatccgccacggacaaccccgcacacgccaacgcctgccgaatcacccgctgctgcgacggaccattcggcgccgtcaacccattcgacgcaccgtcctgattcaccgcactcccccgcaccaccgccaaaacccgatgaccacgacgttcagcctcggacagccgctccaccaacagcacacccacaccctcggcccagccgaccccatcggcccccgacccgtacgccttgcaccggccgtccggcgacagaccccgctgccgcgagaactccacaaacgcacccggcgtcgacatcaccgtcacaccccccgccaacgccagcgaacactcccccgacctcaacgcctgacacgccagatgcagcgccaccaacgacgacgaacacgccgtatccaccgtcaccgccggaccctcgaagccgaaggtgtaggaaagccgcccggagacgacgctgttggagacgccggtgagcgcgtacccctcgtggtcctgggtgccgcggcgcaggagctcggcgtagtcctgctgcgagacgccggcgaagacaccggtcgtggacccgtgcagcgtggcggggtcgatgcccgcccgctccaacgcctcccaggacacctccagcatcaaccgctgctgcggatccatcgccaacgcctcacgcggactgatcccgaaaaaccccgcatcgaactccgccgcaccctgcaaaaacccaccacaccgcgtgtaggacgtacccgcccgccccggctccggatcatagaaagcctccacgtcccaaccccggtcgaccggaaactcccccaccgcatcccgacccgacgcgatcaactcccagaaatcctccgccgactccacaccccccggaaaacggcacgccatccccacaatggcaatcggctcgtcgacatccacacgcggtgccggggcccgaagggcaagggcaagggcagtgccggtggtcgggcttccgccgctcagctgctcgtggatgtgtgccgcgagtgccaccgggcggggatggtcgaacaccagggtcctcgggaagcgcaggcccgtggcggtgttgaggcggttgcgtagttcgacggcggtgagggagtcgaaaccgaggtcgcggaaggcgcgctcgggcaccaccgcatcggcggtgccgtgtccaaggacggccgcggcatgggtaaggaccaggtccagcacggtctcggcctgtgcggcggggtcgagtccggcgaggcagtcgcgcagcatgccgccgcgcacggtgtccaccgcctccgacaactgaccaccccactgcccagagaccccggaaccccgcggcgccccctccacatccagccaaaagcgctctcgctcgaacgcatacgtcggcagctccaccccgcaaccaccagcgaccccgcgaccaacactcccgaacacaccggaccactcaaccgccaccccacccacgaacaactcggccacggacatcaggaagcgtcgcaagccgccttcgccccggcgcagagatccgacgaccaggctgtccaagtcacccatctcgtccagggtttcctgcacaccgaccgcgacggccggatgcgggcacgcctcgatgaagacggtgtggccggcgcggaccagcgcctgtgtcgcgtcccggaagcggacgacctggcgcaggttgcggtaccagtagtcggcgtcgagttcggtgccgtcgatgcgttcgccggtgacggtggagtagaagggcacgtcgccggtcctcgcgcggatgggggcgaggagttcgagcagccgcccctggatcgcctcgacctgcggggagtgcgacgcccagtcgaccatgagcctgcgggccggtacgtcttcgtgtgacagctcctccaccagggcgtcgaccgcttccggctccccggagaccacggccgaacgcgccccgttcacggcggcgatgaccagacggtcgccccatgtcgcaagacgcggctccagcttctcgaccggcagaccgaccgatgccatcgccccctgcccggccagtgcggccagcgcctggctgcgcagggcggtgacccgggcggcgtcgtcgagggagagtgcaccggcgacgtaggccgctgcgatctcgccctgcgagtgcccggccaccgcgtccgggtgtacaccgtacgagcgccagagcgccgccagcgagaccatcaccgcgaagaggacgggctggacgacatcgacgcgttgcagagggggtgcgtccggtgcgccgcgcaggacgtcgaggagagaccagtccaggtacggttcgagggcttgggcgcagtcggacatctgctgggcgaagaccggtgaggagccgaggagttcctgcgccatgccttcccagtgggtgccctgtcctccgaacagcatggcgatctttccgtcggccgccggtccggccacaccctgtaccacccccgcggtgggtgccccctcggccagtgcgtcgagtgcgtgcaggaactcgtcgcggtcctcggccacgaccaccgcacgatgctcgaacaccgaccgctccgacaccaaagcccgcccgaccccagccggactcacccccacaccatccgcacccccaccaaccgccacaaccccacgcaaccgacgcgcctgcccccgcaacgccaactccgaccgcgccgacaccacccacggcaccacccccgaacccgacaccacccccggacccaactcctgcagccggcccgcacccccatccgcgcccccggacgcctcctccaaaatcacatgcgcattcgtcccactcaccccgaacgcagacacccccgcacgccgcagccgaccctccacccccggccactccacctcatccgccaacacacgaaccgacccactcgaccaatccacctgcgacgacggctcatccacatgcaacgtccgcggcaacacccccgcccgcaacgccatcaccatcttgatcacacccgccacacccgcagcagcctgcgcatgcccgatgttcgacttcaccgaccccaaccacaccggccgctcccccgaacgaccctgcccataagtggcgagcaacgcctgcgcctcgatcggatcacccaacgtcgtacccgtcccgtgcccctccaccacatccacatccgccacggacaaccccgcacacgccaacgcctgccgaatcacccgctgctgcgacggaccattcggcgccgtcaacccattcgacgcaccgtcctgattcaccgcactcccccgcaccaccgccaaaacccgatgaccacgacgttcagcctcggacagccgctccaccaacagcacacccacaccctcggcccagccgaccccatcggcccccgacccgtacgccttgcaccggccgtccggcgacagaccccgctgccgcgagaactccacaaacgcacccggcgtcgacatcaccgtcacaccccccgccaacgccagcgaacactcccccgacctcaacgcctgacacgccagatgcagcgccaccaacgacgacgaacacgccgtatccaccgtcaccgccggaccctcgagccccagggtgtaggcgacgcgtccggatgtgacgctgctggacaggcccgtcatggcgtagccctcgaggtcctcggtggcccggcgcacgaggtcggcgtagtcctgactgcacatgccggcgaagacaccggtcgtggacccgcgcaacgtggcggggtcgatgcccgcccgctccaacgcctcccaggacacctccagcatcaaccgctgctgcggatccatcgccaacgcctcacgcggactgatcccgaaaaaccccgcatcgaactccgccgcaccctccaggaaaccgccccggcgcgtatacgacgaacccgcccgccccggctccggatcatagaaagcctccacgtcccaaccccggtcgaccggaaactctcccaccgcatcccgacccgacgcgaccagttcccacaagtcctccgccgactccacaccccccggaaaacggcacgccatccccacaatcgcaatcggctcgtcaacgtcgacacgcgacgccgggaccggaggagcaatgtcacgctggccgcccgcgccctcctccagctgttccttgaggtatccggccagcgcggagggagtggggtagtcgaagatcagcgtggtgggcaggaggagcccggtgacggcgttgaggcggttgcgcagttcgacggcgctcacggagacgaagcccaggtcgcggaaggctcgctcagggcgtacggcggtgggggtgctgtgtccgagcacggtcgccgcgtacgtacggaccaggtcgagaagcgcacgttcctgctcggcggtgtccatggccttgagccgtgcggagaacgagtcgggggatgcggtggcggtgtcgagtccggtggtttcccgggcgaggcgtgcttcggggatgtcgctgatgaggggcgagagtcgggagccggggagggagttggcggtgaatcggtcccagtcgatgtcggcgaccgtcacacaggtctcgtcatggtccaacgcctggcccagtgccaccagcgccgtctccggcgtcatcgccgccagaccccgacgccgcatctgccccacggccccctccgccatccccccaccagcccacggaccccacgccaccgccaaccccggcaggccctcaccacgccggtgccgaacgattgcctccacatacgcgttcgccgccgcgtaactcccctgtcccgccggcccgaacgtcgccgcagccgacgagaacaccacgaaccccgaaagatccgccccccgcgtcaactcatgcagattccaggccgccagcgccttcgcccgcagcacccccgtgacacgctcggacgacaacccctccaacaccccgtcatccacaactcccgcggcatgcaccaccacacccagcgggcactccgccggaacggccgaccgcaacacctccgccaacgcctcacggtccgccgcatcacacgccaccaccgacacccgcgcgcccaagcccatcaagtccgctcggagttcttcgactccctgggcgctctccccgcgtcggctcaccagcagcaggtgttcggcgccacgccgggccatccaccgggcgacgtgcgcacccaactcgccggtgcctccggtgacgagtacggtgccgcggggccgccactcccgctccgcgacggcctcctccaacggcgcccgcaccaaccgccgcacaaacgcccccgaagaccgcacggcaaactcactctcaccccctccccccacacccgccagcacacctaccaacccatcgaccacccgctcatccacgagctccggcacatcaaccagcccaccccagcggtccggtgcctccgcccccaccacacggcccagcccccacaccacacccgaggccggcccccacacagcatcccggccccccaccgacacggccccgcccgtcacacaccacagccgcgcccccacgcccacatcacccagcgcctgcaccaaccccacagacgccactcccgcctgcacgacgccactcccccagcccacaagggagacgacaccgccgacagcctcaccatcgaccgcctcacgcaggtggccggccaacacttccctgctcacacaccccgcttccacctccacccgaaccactcgcgccccacaccgctccaacccctccgccaccacatcaaccgggcccgcctcgccctcggacaccaccagccacgcgcccgacagcccccctacaccaccgcccgaaacgggtcgccacacctcccgatagcgccacccgtccaccacttcacgctcgtgccgtacccgcccccattcccccaacgccgacaccaccgcacccagcgacgccccctcatccaccccaaggagcgatgccaccacccccgcatcaccacactcgaccgcctcccacaacggaccaccccacatcccggaaaccccggaacctcccgcagatccctcctccacgtccagccaaaatcgctcccgctcaaacgcatacgtcggcagctccaccccgcatccatcaccgacctcgcgagcagtcccctcgaacacaccggcccactcaaccgccgtcccagccacgaacaactccgccagggcggtcatgaccgaccgtgcctccggctggtccggccgcagggcggggatggcgcgggccggtgcactgagcgagtcctgtgcgagggccgacagcgtgccgtcggggccgatttcgaggcaggtggtgacgccctgttcctgaagccatgagatgccgtccgcgaaacggaccgtgctgcgggcgtgttcgacccagtagtccggggtgcacatggtctcggcggggaggggcgcgccggtgacgttggagacgacgggaatccgcggggcgctgaaggtgacctgctcggccgcgcggcggaagtcgcccaacatggcgtccatgtgcggcgagtggaaggcgtggctggtccgcagccgccgggtgcggcggcctcgtgccgcccattgctgcgcgaggtccaggaccgcgtcctcgtccccggagaggacgatcgaccgcggcccgttcaccgcggcgtgcgcgacccgggatgcgtattcgtcgggcagcgggaggatctcgtcctcggacgcctcgatggccaccatggctccgccggacgggagcccttgcatcaggcggcctcgtgcgaccaccagtgccaccgcgtcggcaaggcagagcatcccggcgacatgggcggccgccagttcaccgacggaatggccgaggacgtagtcgggcgtcagaccccaggtctccagcagccggaacagcgccacctcgaaggcgaacagggcgggctgggcgaaacccgtgtcctcgatcagccggccttcgggagagtcctgcggtgcgaagagtacgtcccgcagcccaggggcaccggggtcggtgcgggcggtgtcggcctccgcgcagatctcgtcgatggcctgggcgaagacggggtacgcctcgtacagttcgcggcccatgcctgcgcgctgggttccctgcccggcgaagagtacggcgagttcgcccgaggtggttcgtccctcgacgacgccgggcacggggcggccgccggccagtgcgtcgagtgcgtgcaggaactcgtcgcggtcctcggccacgaccaccgcacgatgctcgaacaccgaccgctccgacaccaaagcccgcccgaccccagccggactcacccccacaccatccgcacccccaccaaccgccacaaccccacgcaaccgacgcgcctgcccccgcaacgccaactccgaccgcgccgacaccacccacggcaccacccccgaacccgacaccacccccggacccaactcctgcagccggcccgcacccccacccgcgccccccgacgcctcctccaaaatcacatgcgcattcgtcccactcaccccgaacgcagacacccccgcacgccgcagccgaccctccacccccggccactccacctcatccgccaacacacgaaccgacccactcgaccaatccacctgcgacgacggctcatccacatgcaacgtccgcggcaacacccccgcccgcaacgccatcaccatcttgatcacacccgccacacccgcagcagcctgcgcatgcccgatgttcgacttcaccgaccccaaccacaccggcgtgtcaccggcccgctgcccgtacgtggcgagcaacgcctgcgcctcgatcggatcacccagcgtcgtgcccgtcccgtgcccctccaccacatccacatccgccacagacaaccccgcacacgccaacgcctgccgaatcacccgctgctgcgacggaccattcggcgccgtcaacccattcgacgcaccgtcctgattcaccgcactcccccgcaccaccgccaaaacccgatgaccacgacgttcagcctcggacagccgctccagcagcaaaatccccacgccctcggacatgccggtgccgtcggcagccgacgcgtacgccttgcaccggccgtccggcgacagaccccgctgccgcgagaactccacgaacatgcccggggtggacatgaccgtcacgcctccggcgagggcgaaggaggactcaccggtgcgcagtgactggcaggcgaggtgcagtgccaccagcgacgacgagcacgccgtgtcgaccgtcaccgcggggccctcgaagccgaaggtgtaggcgacgcgtccggacaggatgcttcccgcgttgccgttgcccaggtagccggccaggtcgtcggggaccgagagcagacgggtcgcgtagtcctgggacatgaggccggcgaagacgcccgtccggctgccgcgcaacgtggcggggtcgatgcccgcccgctccaacgcctcccaggacacctccagcatcaaccgctgctgcggatccatcgccaacgcctcacgcggactgatcccgaaaaaccccgcatcgaactccgccgcaccctccaggaaaccgccccggcgcgtatacgacgaacccgcccgccccggctccggatcatagaaagcctccacgtcccaaccccggtcgaccggaaactcccccaccgcatcccgacccgacgcaatcaactcccagaaatcctccgccgactccacaccccccggaaaacggcacgccatccccacaattgcaatcggctcctgctcgcccgattcaatctgctgaagtcgacgccgcacattgaggagatcggcagtaacgcgcttgagatagtcgcggagcttttcctcgttagccatggaccggtctcctcgacaagagaaatcggaaattaaaaaacacgcatgggactctcacaggctagagcgacgagagcagcacaaatacccctagataccccagacccctgatgctcgatgaatgccgctatagctagggggtatggcgccagacatgaattcacagcgtttcggcggccggctggcgcttgtcacaggtgcaggcggtggcatcgggcgggcgaccgcctgcgctctcggatcggccggggcgcgagtggtgtgcgtggaccgggacggccgcggcgccggggtgacggccgacctggcccggacgcggggcgcgcgggcggcctggcccgaggtggccgacgtgtccgacggagcggcgatggagcggttcgccgagcgcgtcgccgagacgtacggggtcgtggacctgctggtgaacaacgccggcatcggcatggcggggcgttttctcgacacgtccgtcgaggactggcagcgcaccctgggcgtcaacctctggggtgtcattcatggttgccgcctcatcggccggcagatggcggagcgcgggcagggcgggcacatcgtgacggtggcgtcggcggcggcgttccagccgacgcgggcggtccccgcgtatgccaccagcaaggcggcggtgctgatgctgagcgagtgcctgcgcgcggagttcgcggagttcggggtcggagtgagcgtggtgtgcccgggcttcgtccgtacgtcgttcgcgtcggcgatgcatttcgccggtgtgccccggctggagcaggagcggctgcgggcgctgttcgccggtcgcggatgcagcgcggagaaggtggccgcggcggtactgcggtcggtggcgcgcgactcggccgtggtgaccgtgacggcggaagcgcggctgtcacggctgatgagccgcttcacgccacgcctgcgcgccgcggtggcgcggatggatcccccttcgtagggctggcggggatcccctccttgccttcgaacatcttccgacgatgggcagtgagagatgtcagatcattttctcttcatgagtgcgccgttctgggggcatgtgttccccagtctcgccgtggcggaggagctcgtgcaccggggccaccacgtcacctttgtgacgggcgcggaaatggccgatgcggtgcgttccgtgggcgctgatttcctgcggtacgagtccgccttcgagggtgtcgacatgtaccggctgatgaccgaggccgagccgaacgccatccccatgacgctgtacgacgagggcatgtccatgttgcgttcggtggaggagcacgtcggcaaggacgttccggacctggtggcctacgacatcgccacctccctcaacgtgggtcgtgtcctcgccgcctcctggagcaggccggccatgacggtcattcccctgttcgcgtccaacgggcgcttctccacgatgcagtcggtattggatccggattccgctcaggtcagtgcgccgccgccgcgcttctcggagcagatggagttgttcggcctcggggcgctggtgccgcgcctcgcggagctgctcgtttcccggggtatcacggaaccggtcgacgatttcctttccggaccggaggacttcaacctggtgtgtctgccgcgcgccttccagtacgcgggcgacaccttcgacgagcggttcgccttcgtcggaccatgtctgggtaagcgcaggggtctgggcgagtggacaccaccgggcagcgggcatccagtggtgctcatctccctcgggaccgtgttcaaccggcagctgtccttcttccgcacgttcgtccgggcgttcaccgacgtccccgtgcacgtcgtgatctcgctcggcaagggggtcgaccccgatgtgctgcggccgctgccgccgaatgtcgaggtgcaccggtgggtgccgcaccatgcggtgctggagcatgccagggctctggtcacgcacggcggtaccggcagtgtgatggaggcactgcacgcagggtgcccggtgctcgtcatgcccttgtcgcgggacgcgcaggtgaccggccggcggatcgccgagctggggctgggtcgtatggtgcagccggaggaggtcacggcgacgacgctgcgccggcacgtgctggacatcatctccgatgacgcgatcacccgacaggtcaggcagatgcagcgggccacggtcgaggcgggcggcgccctgcgggcagcggacgagaccgagcggtttctgcgccggacgcgccgtcactgaccggcagctcgggccgggcggtgagtggctcccacagggttcggttctccacgtaccactgaacggtctgtgccagcccctcctcgaagggcacgcggggcgcgtaaccgagctcggcggagatcttgctgatgtccagcgagtagcgccggtcgtgccccttgcggtcggtcacgggttcgaccatcgaccagtccacgccgagcaggtccaggagccgggcggtgagctcacggttggacagctccgtcccgcctccgatgtggtagatctcgccgggcctgccgcgttcggcgaccagggcgatgccacggcagtggtcgtccacgtgcagccagtcgcggacgttttcgccgtcgccgtacaagggcaccttcgtgccgttcagcagatgggtgacgaaccgcgggatgagtttctccgggaactggtgggggccgtagttgttcgagcatcgggtgatgatcactggtaggccgtgcgtgcggtggaaggaccgggcgagcaggtcggaggacgccttggacgcggagtagggcgagttcggctccagcggggcgtcctcggtccacgagccggagtcgatggagccgtagacctcgtccgtcgagatgtacacgaagcggtccacggcggcgtcggtggcggcgcggagcagggtgtgagtgccgaggacattggtgcgtacgaactcggcggcgtcggccacggaccggtccacgtgtgactccgccgcgaagtggaccaccatgtcggagccgtccatcaggtccgcgaccaagggcccgtcgcagatgtcgccgtgcacgaagatcagggatgggcttcccaggaccggtgcgaggttctccaggcgacccgcgtaggtcagcttgtcgagcaccacgacctcggcaccggtgaacgccggatacgcgcccgtcagcaaccgccgtacgaaatgggaaccgatgaaaccggcgccgcccgtcacgagtaggcgcatcccgggctcctcaccgcggcttccgccgcaatactcatcagatactcgccgtagccggagccggccagttcgaccccgcgcagatagcagtcgtccgcgtcgatcagacccatccggaaggcgatctcctcgagacaggcgatccgtactccctggcgcttctccaggacctgcacatactgcccggcgtgcatcagcgagtcgtgcgtccccgcatcgagccaggtgaagccccggcccaggtccaccagccgggcccgcccctcggcgaggtaggccctgttgacgtcggtgatctccagctcgccgcgggccgacgagcggatgccccgggccacctcgatcacgtcgttgtcgtacaggtacaggcctgtgatcgccaggttggaccggggggcggtgggtttctcctcgacggacagcagctttccggaggcgtcgacctctccgactccgtaccgttcgggatccgtcaccgcgtatccgaacaacacacagccgtcgacatcgcgggtgtggctgcgcagcaggtgcgaaaagcccatgccatggaagatgttgtccccaaggacaagggacacctgatcctgaccgatgaaatcggcgccgatgaggaatgcctcggcgattcctcccggtcgctgctgcgcggcgtagtcgatgttcagcccgaggcggcttccgtctccgagcagtctccggaattgttcgagatgatcgggtgaggaaatcaccaggatgtcttttatgccgccgagcatcaacacggagagcgggtagtagatcatgggtttgtcgtagacagggagcagctgcttggaaagggcacgggtcaacgggtaaagccgagagccggttccccccgcgagcacgattcccttcatgtcggactccccgcagtcgacgttatatatctctgccgtctgcccgacggtaccaagtggcggaaaacgcaccaggaattcgagcgccgctagggggaagggctcaagaagataggggccaccagatggggcggttttcggtgtgcccgccccggccgaccggaatactgaagagcatgctgacgactgggatgtgcgaccgaccgctggtcgtcgtactcggagcctccggctatatcgggtcggccgtcgcggcggaactcgcccggtggccggtcctgttgcggctggtggcccggcgaccgggcgtcgttccgccgggcggcgccgcggagaccgagacgcgtacggccgacctgacggcggcgagcgaggtcgccctcgccgtgacggacgccgacgtggtgatccacctggtcgcgcgcctcacccagggagcggcatggcgggcggcggagagcgatccggtggccgagcgggtgaacgtcggggtgatgcacgacgtcgtcgcggccctgcggtccgggcgccgcgccgggccgcccccggtggtggtgttcgccgggtcggtctaccaggtgggccgcccgggtcgggtcgacggcagtgagccggacgagcccgtgacggcctatgcccgtcagaaactcgacgccgaacggacgttgaagtccgccacggtcgagggtgtcctgcgggggatctcgctgcggctgcccaccgtctacggcgcggggccgggcccgcagggcaacggcgtcgtgcaggcgatggtgctccgggcgctcgccgacgaggccctcaccgtgtggaacggaagcgtggtggagcgtgacctggtgcatgtggaggatgtcgcgcaggccttcgtgagctgcctggcgcacgcggatgcgctcgccgggcggcactggctgctcggcagcggtcgtcctgtgaccgtcccgcacctcttcggtgccatcgccgccggcgtgtccgcccgcaccgggcgccccgcggtgcccgtgaccgcggtggaccctccggcgatggcgacggcggcggacttccacgggaccgtcgtcgactcctcggcgttccgcgcggtcaccgggtggcggccgcggctgtcgcttcaggagggcctggaccacatggtggcggcttacgtgtagcgccggggtggcggccgggcccgggcggtgacggcccggatccgggtcggccgtcacagcttctcgtcgaggccgcggctcgcgcggtactccggcaacatgccgcgtcgcagggcctgctggagagtcggcgcgcgccggtcgcgctcggagaggatcggtgcccgcccgaggtggtggccgaggggcagggcgaggtccggatcctcgggcgagagggcgtgttcgttctgcggaacgtagccgctcgacatcaggtacaccatcgccgtgtcgtcttccagcgccacgaacgcgtgcccgaccccgatcggcaggtagacggaacggaagcgctcctggtcgaggaggaccgagtcccactgcccgaaagtcggtgagccggtgcgcaggtcgacgacgaagtccagggcccgtccccgggcgcagtggacgtacttggcctggccgggtggtgtcgcggtgaagtgcacgccgcggacgacgccgcggcgcgagacgctctggcaggtctgcgcggtgggaaaccggtgcccgacggcctcgctgaggaccggttcctggtagggggtgacgaagagcccgcgctcgtcggggaagaccgtcggggtgaattcgacggcgccctcgacgacgagcctccggaccgtgacaccggcggcggtggcccgggcgcccgcgggcggggcgggccggtcggcggagctccggcgaggccggccaagggtcatcgctgcactctctctgtcgtgcgggttgtcatacgggtagtcgtacgggccggttccggagtcacagctcgacggcgcgggtggtgagcagggacagcagggtgcgggcctgcacgttcacgtaacggccgtaccgcagcagctgggtcagctggcccggggtgcaccagcggtaccccgggggcgggtcgttcggcgcctggctctcgtcggcctcgacgaacaggtagcgcgcctgtgcgtgcagaaagcgaccgccctcctccgagtggaccgccgcgtagcggatgcggtcgggcgcggcctccagcaccaggtcgaggaagcgcggcctggccggtcccgtgaggtgggcgtagttgcgcggggtgtactggaccgtcgggccgagttcgatcgtgtcgaggaagccgccctcgaccctgccgtgggcgagcaggtgcggtacgccgccgatccgccgggtcaggaaggcggtgatgccgtggccgcacggttcgatcaggggctgggtccaggcggcgacctcccggttggaggcctcgacacggaccgcgaccacacggaagtaccggtccgcgtggtgggcgatggactccgcgcccgtggtccagccggggatgccggccaggggcacgcggcgggcgtgcacggagtgccgggagcgttcggcggcgtaccaggagagcagttcggcgtcgctgtgcagggccgcgggctcgtcgaacggggtgggaaggcaggcgaggaccgtgcgtgcgtccatgttcaccaggttgtcccggtgcatcagttcgccgatctgccccagtgtcagccagcggaagtcgtcgtccagtggtacgtcctcgtcggtctccaccacgatgttgcggttgaacttccggtggaaccaggctccgtgctcggactggaggacgtcgaccaccacggtggcgcgccggggctgtgtgaagtactcgaggtacttcacggcggcgcccccgtggaccttggtgtagttgctgcgcgtggcctgcacggtgggcgacagctggaccaggttgatgttgccgggctccatcttggcctgcatcaggaagtgcaggaccccgtcgaacttcttggcgaggatgccgaggatgccgatctcgggctggtggatgatgggctgctgccattccgggaagggctgttcaccgcctcggacgtgcagtccctccacggagaagaaccggccgctgcggtgggccagattgccggttccggggtgaaacgaccaggcgtccatcccgtggaaggggatgcgctcgacccggaaccggtgggccccggaccgccgcgtccaccagccggtgaacgcgtcgagggacgtccggcgccggtgtcgcccacggcggcggagcgggcgaggcacgcgggcagggcggcgtcgtgccgcgcggtgagcggtgctgggctcggtgtggtcggcatcggctcgtacgctcatgcaccccacgtcatgtagatcaccggtggctcgcggccgggcagttggcgcagtggggcgtggtcgaggccgaacgcctcgctcagcgccctggtctcccccggccatttggggtgggtgagttcgtcgaaggcgaggatgctgcccctggtcaggtgcggtgtgatgacgtccagcagttcgcgcgtggggcggtagaggtccaggtcgaagtaggccagcgcgatgacggtgtgcgggtgttccgccaggtattggggcaccgtttcgcgtacgtcgccctggaccacgaaggaacgctgggtgtggccgtagggttcgttcgcctcgtgcgccgcgagcacctgccgcaggtgctccacttcgccgtccggcacggcgaaccgcccagggaccgcgctggtgctgacctcgtccgcctcgtcgatgtcggggaagccggtgaacgtgtcgaagccgatgacgcggcgcagcgagttgtacggctcatagatgctgcgcagcgcggtcagcgtggcgaggtgccgtccgtgcagaacgccgaactccatgatgacgccggggacttccggcagcatgcggtacagcgcgtccatggagagcaggtcggcgagctggttgcgccgcatgtagacggacaggttgtcgatcaggtacttcggcgggatcgggctgtcgacgaggagcttggtcagctgctcgcgggcagcgcgttcctgctcggactcgtgcggcacgatccggggatcggtgaactcccgctcggtcatggaggcctttcctttcatgggtcggtaccgggcgcgccggacgtgccggtcgtaccgggcgtgccggcgggcacgacgctgtcgggtcaggacagccaggcgtcgggggcggatccgccgcggccgaccggggggaacagctcctccaggcgggccaggacgggctcgggcagcggggtgcgcagggcgtgcagtgccccgtccacgtgctgttcggtgcgcggcccgatgaccagcccggtcacgccgggccgcgacagcacccaggccatgccgacatgggcggggtcgaggccgtggtccgcgcacacgtcctcgtacgccgcgatggtggtgcggtggtgctccagggcctcgacggcccggccctgtgccgacttgaccgcggtgttctcccgcgtcttgcgcaggacaccgccgagcaggccgccgtgcagtggcgaccagaccaggacgccgacaccgtaggcggacgcggcggggatgacttccagctcggcgtgtcgggtcacgaggttgtagacgcactgctcggaggcgaggcccagggcgttgcgccgccgggccgcctcctgggcggaagcgatgtcccagcccgcgaagttggaggagccgacgtagcgcaccttgccctgcgtgatgagcaggtccatcgcctgccacacctcgtcccagccggcgcggcggtcgatgtggtgcagctggtacaggtcgatccagtcggtgcgcagtcggcgcagcgaggcgtcgcaggcggccacgatattgcgtacggacagtccgtgatcgttggggccgctgcccatcggatcgccgaccttggtggccagcaccacctgctcacgccgggcggggcggtccgccagccacctgccgatgacctcttcggtgtaccccttgtggacgcgccagccgtaggtgttggcggtgtcgaacagggtgatgccctgagccagggcgtgatccatcagtcggcgcgcttcgggctcctccacccgtccgccgatgttgaccgttccgagcgccagtcggctgatcctcagccgggtcctgcccagttcggtgtggaggggagcactgctgttgctgtcggactggacgggtgcgggctcggccgtcgtaggcatcatcgatcagtcgacactccctcgtgcgtgagcggcgggcgctcgagcaggaccctgacctgaggcccaggaggctaccggcgatcatgcgatacaggcagccgctcgatggtgggacacgggctgccgtcgccgggcataggggctgatgggggttgtccggtgcgggtccggctgacagcttcgtggacaccaagttgatccagttgatccactccgaaaggcagaggctgcagcgcgatgaccagtgttcagacgagcgacaactggctccggcgtttccatccggccgcggaggctccgacgcgactggtctgctttccgcacgcgggcggctcggccgcctacttccacggtgtttcccgtgcgctctcgccggccgtcgacgtcttggcggtgcagtatccgggccgtcaggaccggcggcacgagccgctcatcgacagcatcgacggcctggccgcccgggtacgggaggagttggcgccgtggacggaccggccgttggccctgttcgggcacagtatgggcgccatggtggcgttcgaggtggcgctgcggctgacggccgacggcgccgcgccgagcgtgctgttcgcctcgggcaggcgggcgccgtctcggtaccgcgaggaatccgtacacctccatgacgatgcgggcatcatggcggagctgagccgtctggacggcaccgatacgcaggtactgaccgatccggagctgcgggagatggttcttccggcgttgcgcagcgactaccgggcggtcgagacgtaccgctaccaaccggggccgccgctgccctgccccgtggtcgccctggtgggcgacagcgatcccaaggccacggtcgacgaggcccgcgcctggggcgatcacacggccggaccgttcgaactctcggtctttccgggtggccacttctatctcaatgcgcacgcggaagccgtcacggaattggtgcggacgcgactggcgaccatcaggtgatcaaggtgacgtaggtgttcaccatggcggagttcagggtcgtgctccagccgaagtcacccggacccggcgaggtctcttgctgcgcgccgcaggccacagcggcagccctctcgggtccggcgcggcaccgcactggcggcgctgtgtgcgctcaccctcgccgcctgcggcaccgaacgagcgggcgtcagggggccgaaggccggccccgcgctcgagacggtggacacattgcggctggccttcctggactcgctgaccaacacgtcccgcgtcttcgcaggtccttgacggtctcttgacgaatccggcggacatggagggcggctgccgggtaaggcgcggggcgtgacacgtattggattggtcgtcctcgccctggccgcggccctcgcggcgggcgccgccgcggggtcgatatcgccgtggtggtggttcgccgccgtcccactcaccctgctgggcctgctgggcacgtgggaccttttgcaacgccggcattcggtgctgcgcaactaccccgtcctcgggcacgcccgcttcctcctggagcggatacgtcccgaactccagcagtacttcgtcgagcggaacttcgacggccgccccttcgaccgggatgtgcgcagcatcgtctacgagcgggcgaagggtaccgacgccgagcagccgtacggcaccgagcaggacgtctaccagcccggctacgagttcctgatcccgtcgatggcgccccgcccggtgccgcagacgccaccgcgggtgcggatcggcgggcccgactgcagccgcccgtacgacatggcgctgctgaatgtgtcggcgatgagcttcggctccctgtcgtcgaacgcgattctcgccctcaacgggggcgccgcggccgggggtttcgcccacgacaccggcgagggcggcctgtcggagtaccacctgcgtcctggcggtgacctcgtctgggagatcggcaccggctacttcggctgccggacccaggacggcgagttcgacccgaaggagttcgccgacaaggcggcgcacgagcacgtgaagtgcgtgtcgctcaaactctcgcagggcgccaagcccggcatcggcggggtgctgcccgggccgaaggtcaactccgagatcgcgcgggtgcgggatgtgcccgaggggcggacggtgatctcgcctccgtaccaccgggagttctccaccccgcgcgaactcgtcctcttcatcgccaggatgcgggagctgtccggcggcaagccgaccggcttcaaactctgcccgggctcgcgccggcagttcctcgccgtgtgcaaggcgatgctggaggagggtacggccccggacttcatcatcgtcgacggggccgagggcggcaccggcgcggcgccgctggagttcgccgatcacgtcggcacgccgctcaccgaggggctgctgaccgtgcacaacgcccttgtcggcgcgggcctgcgcgaccggatcaggatcggggcgagcggcaagatcgccaccggcaccgatctggtcaaacgcctgctccagggtgccgactacggcaacgccgcgcgggcgatgatgttcgccgtgggctgcatccaggcgcagcggtgccacacgaacacctgccccaccggtgtcaccacccaggacccccggcgtgcccgcgctctcgacgtcggtgacaagacgctgcgcgtccagcgcctccaggaggcgaccgtggccagcgcgctgcagatcatggcgtccatgggggtcaccgatccctcgcagctgcgtccgcacatgctccaccggcgtatcgacccctacaccgaacgctcctacgacgagctctatgagtggctgcggcccgggcagttgctcgccgagccgcccgctgcctgggcggccgactggcacgccgccgaccccgaccgtttcaccgtgtgatctggaggatcctgtggcccgaaccgttgcccgcgtcatcgtggacgcgctgagtgagcttggcgtgcgccaggtcttcggcgtcgtcggcgacgcgctcaatccggtgaccgacgccatccgcaccaccgaggacgtggagtgggtgggttgccggcacgaggaggcggcggcgttcgccgcgagcgcccagtcgcagctcagcggcaccctcggtgtgtgcatgggcactgtaggacccggctccgtccacctcctcaacgggctgtacgacgcggccaagagccgtaccccggtcctggcgatcgccggccaggtaccgctcgccgaactcggcagcgactacttccaggaggtcgacaacgacgcgctcttcagtgacgtggcggtcttccgggcgacgatcacctcgcccgaccagttgccgcagctgctggagacggcggtgcgcaacgcgctgggccgcaagggagtcgccgtcctcaccgtgccgggcgacctcggcgaccgggagctgagcgcggaccggccgacccgcttctccctgagtacccccgtgagccggccggaggagtccgccgtgcgccgcgccgcggagctgctcgaccgcgcggaacggatcacgctgctcgtcggacggggtgcccgcgccgcgcgtgctgacgtactgaccctggccgaccgcctcgccgcgccgatggtgctcaccctgaaggccaaggagggcttcgaaggtgaagccaatcccttccaggtcggccagaccgggctgatcggcaaccccgcggcggcatcggccctccaggacgcggacacgctcctcctgctgggcaccgacttcccctaccgcgactggtatccggacggccggacggtcatccaggtggacagcgaggccgcgcacatcgggcgccgggtgcccgtcgaggtcgggctcgtgggcgacacgggcgccaccgtccgggatctgctcggccacctcgccaccgcgcctcccggcaccgagggcgcgcgggaccgctcgcacctggaggacgcgcgcaagagcttcggcaagtggcgcgcgagtcaggcccggctcgccgacccggcgcacgacaagggcctcgtcggacgggtccgctccgcactggacaaccgcgcgcacgacatccgcccggaggcgctggccgccgtggtggaccgggtcgccgacgagaacgccgtcttcacctccgacacgggtatggccacggtgtggctctcgcggttcgtcgagatgcgcggtgaccggcgactgctcggctcgtacaacctcggctcgatggccaatgcgatgccgcaggcgctcggcgcccagtgcctggaccgggggcgccaggtcgtggccttctgcggcgacggcgggctgagcatgctcctcggcgacctcatgacgctgaagacgagccggctccccgtcaagctcgtcgtcttcgacaaccgccggctgggcatggtgaaactggaacaggagcaggccgggctgccggagttcggcaccgtgctggacaaccccgacttcgccgccgtcgccacggccatgggcatcaccggtatccgcgtgaccgatccggccgagctggaggagtccgtgcgccgcgcgttcgccactcccgggcccgtactgctcgacgtgctcacgaacccggacgagatcgccgtcccggccaagccgaccgtcgagcagggctggggcttcgcggtggccaaggtgaaggaggtcgtgcgcagccacggggacagcgacgggcactgatccgggcgcggcgggcgcggcggtcgcggacgggggcgcggcagtcgcgggccggggtgcggcggagaacggtgtcggtatcggaccccggagtgcggtggaagtcgtcgccgcgaagccagggccgtgggcgcgtctgtgcccgccacatcctcggacaggggggaccgctccggcgccggcacgacctgcgtgctgccggggacctcctcagtgatctcgttaccgagcctgcatcggcgtgtccccgtaccggggtgctccaggggtgccgtgccagtccaggatcaggaccgtggcgtcgtccttgaggttgccgtcgcaggtctccagcaccccggccgtcagagctcggacggcttcccgtgggtggaaggcgcgggtgtcgtgtacgagcgcgggcaggtcgacggccgcggcgccgcgctcctgcatgccgtcggtgagcaggatcagccggtccccggggcgcaggggcagttcctgtacgcggtaggcggtgggtgccgacacgccgaacggcaggttgacggcgagtttgacctcttcgacgatgccgtcgcgcagacgcagcggccagggatgtccggcgttgaccagacggcacatgcctgtttcgaggtcgacgcacaggagttgtccggtggccaggccgcggctgtggttcagcagggcttggtgggcgtggtgggcttgaagggcggcgtcacagccgctgcggcgggcaccgcgcagggcaccgaccagcaaggtggccagcagagcggagtcggtgtcgtggcccatggcgtcggtgatggacaggtgcagggtgtcgcggtcgagggtgtagtcgtaggtgtcaccgccgatgtcgtcagccgggatcagccctgcggcgagggtgaactgggcggcctcgcaacaggaggccgaggggagcagctggtgctggatctccgcggccaggctggtcttggtggtacgccggcccaagtggtacaggtcggtgaaccggcggtccgtgacgatgatgtaggcgagcgcgtgtgccgcttcgccgacctgtctgagcacggtgtcgtcggcgtactggagggtcacctccagtacgccgatgcagtcgccgcggttggtgacgggcgtgatgacgcgctgtccgccctggccgtccggttccacatgctggcgctggctctgcagaacgatgtcgtagacgctgcctcgcaggccgaccggctcggcatgctccacggcatcaccctcgacggccggagtcagccgcaccagccgctgaccaatgaggtcgacgaacaggaaggacacacgctccgccccgaaccgctttcgcaggttgcgtgcgatcacgtcaacggactcccccggcggcgcggcctccgcggcggccagaagctcacccagttccagatctccgccatccatgacaacctccgatcgactgcctctactccttcccagggtttcttcgacatcacccggcgcggccgatcacgactggcctggaccacgccggtccactccaccccgagctgttcggcgacgaccgtttccatcccgggaccatgggcacgtggatgagtgagtgcctacgaaaggaccgacatgagtgccggagaaaaggccaaggccaaggccgagcaggttgtcgggaaggccgtgaggaaggcagcccatgcgatgggccaggagaccaccgccgccaagggcgccgcgttggaggcccggggcaaggcccgggacaccaaggagagggcgaagggcagcttcaggcactgaccgcgccccgctcagggtgaaggccatgagcggagccggcctgccacctgagcaggctcgtacgtccgacagcgcgcagccgggcttgcccggctgcgcgctctggttgtggactcgccgtctcgtcctgcggcattgcgcgaagcggccccggtccacgcacgagccgtccggtggaccacggccaggcgaaggtgttccgcccggtggacgtgaagtagtagctggtgcagccgcccgcgtcgtagaccgtggtcgtgagcgcctcttggacggcggtgttgtgctcggcctgcacggccgacgagggcgcccggacacacatccacgaaggcgaccagcccggcgcgtggtctgcatgatcccgaactgcgcgcgccggcagcgcacgtgacggcggcaccgcgcggatgggcacgggcagcccgtcagagtgccccgagcggcggataagaaacagataaatcttctgcgtgtgcgggggttgtggaggggcacacggcgggacggaggttgataactatggttcccctgctgctcgttcttctgctcgccctgatcctcttcggtgccggattcgcactcaaggccctgtggtggatcgccgtgatcgtcctggtgatctggctggtcggcttcttcgctcgctcctcgggagcaggtgggaagcgaggccgctggtatcgctggtagggcgcgtccgaagatgccggacgcgggtgggggcgcaccgattgctggtgcgcccccacccgtgtgtgcgtagtcgctcaccggctccacaacgcaggaaccccaccccggatgaccggggtggggttgtggtggagcgccgggcagggcttgcacctgcatttccccgcaggaagcggggcgtctttccttggaccaccaacgcgaggcgcgtcagccaaggttcggcggcacgctcaagatcaagtgtagcgcagccacagcgccgtttcgccacgaccgcgaccggccgggcggcctgctgcccgaccagtcgtccgccgcccgcacgaggtgggtcccgtatcgccttgtcggcgtgccgcggcgccggcggccggcccatgtgctccggaaacctgcggcgttgggccagcgaggcgaactggtcgtcacagcccgcgcagtagccctccagcgattccggtggacttgattcagttgctcggtcgctgctgatcttgggtgactcgctccgtatcgccctcgcgccacggcatcggcccggacaccgcgagacggctcacccgggttcatccccgagagccaaaaaaagtcgctcggcgatgtcgagaacccgtggctggctccgtccccgtgatgaacgcgaccagaatgggtcgtaccagcaccgaggagaaccacgatggccaagtacctgctgctcaagcactaccgcggcgctccggcggcggtcaacgacgtacccatggaccagtggacgccggaggagatctcggcccatatccagtacatgaacgacttcgccgcccggctcgaggggaccggcgagttcgtcgacggtcaggcgctcgcccccgaggggacgttcgtccggtacgacggcgagggccgcccgccggtcaccgacggcccgttcgccgagaccaaggacctcatcgccggctggatggtgatcgacgtcgacagctacgagcgcgccgtcgagctggccggggagctgtcggcggcccccggcgcgggcgggaagccgatccacgagtggctcgagctgcgcccgttcctggccgcgccgcccaccatcaccgagtgacctcgacgatgaacgaggccctgctccggagcctcacaccgagcgtgctcgggatcctcgtccgccgcggagccgacttcgcggcggccgaggacgccgtccaggacgcgctggtcgaggcggtccgcgtctggccggccgacccgccacgggaccccaagggctggctggtcaccgtggcctggcgccggttcctcgacgcgacccgcgcggacaccgcccggcgccggcgtgaggacctcgtcgacgacgaaccggcgcccgggcccgcgcccacggtggacgacacgctccagctgtacttcctgtgcgcccacccgtcgctgacgccgtcgtccgcggtcgcgctcacgctgcgcgccgtcggcgggctgaccacccgccagatcgcccaggcctacctggtgcccgaggcgaccatggggcagcgcatcagccgggccaagcgcaccgtctccggcgtgcgattcgaccagcccggcgacgtcgccaccgtgctgcgcgtcctctacctggtcttcaacgagggctactccggcgatgtcgacctcgccgccgaggccatccggctcacccggcagctcacggccgcgatcgaccaccccgaggtggcggggctgctcgccctcatgctgctccaccacgcccggcgcgccgcccggaccaagcccgacggcagtctggtgccgctcgccgagcagaaccggagccggtgggacacgcagctgatcgccgagggcgtcgagatcgttcaggcggccctcgcccgcgaccggctgggtgagttccaggcccaggccgccatcgcggcacttcacaccgacgcgcccaccgccgaggagaccgactgggtgcagatcgtcgagtggtacgacgagctcgcgcgcctgaccgacagcccggtcgtgcggctcaaccgcgcggtggccgtcggcgaggccgacggaccgcgcgccggcctggcggcgctcgcggcgctggacgactcgctgccccgccacgccgcggtggcggcgtaccttcacgagcgcgacggcgacctggcgacggcggcacggctgtacgccgaggcggcccaaaaggcaccgaacctcgccgagcgcgaccacctgacgcgccaggccgcccggctcaacgcccgcgggtgtcgctgacgggtcgcgctcggatgttcccgcggcacttggcgcggccctgtggccagagcggtcgcctcaaagtgagcaggcgggtcgagaccagtgcgcgacgcgttgccgacggggaggccttgcggcgacgacaggcgcgccggaggcgcgctgacgcccgtgatcaatctcgggcgtactgcgcccgtgatcgatctcggcgctacttcctgtatcgcacgtactcacacatcggagtcgcacggcatccgacgcgggtgcacgggcggcgccgcgctgagctgtcagcggtcggcgatgtcctcgcggaggccgtcggagaattcccaccacgacaaagggagccagtcaccgttgacaaaggcatcgacagtcgcaccgcgaccgcggacagtcacggtcgttcctggcgggtagatggtgccggacagtccgggtacggggaccagaaggcttcccagtcgttgtgctgacacttttcgccttcccttccatttcttggtacggcatcgggaaaatattcaaccgacaataccggtttgtccgatcccgtaggtcggagaatgatgagagatgggtcacgcggagaaaacgcggcagcgtggcatccagacacgtacatcgtcgagcggaggtggcagccatgaaggccgtcgtttacaagggagcattcgacgttgcggtcgaagatgttgaaaagcccagcatccagcatccgaacgatgtgatcgtacggatcacctccaccgcgatatgcggctccgatctgcacatgtacgaggggcgcaccgctgcggagcccggcatcgtcttcggccacgagaacatgggaatcatcgaggagctcggccagggcgtcaccgcgctcaaggagggcgaccgcgtggtcatgcccttcaatgtcgcctgcggcttctgcaccaactgcgtcgacgggttcaccggttactgtctgaccgtcaatcccggtttcgcgggcggcgcgtacggctatgtcgccatggggccctggcagggcggccaggcggaatacatacgcgttccctacgccgacttcaactgcctgaagctgccgccgggaaacgagcacgagagcgatttcatattgctcgccgacatcttcccgaccggctaccacgggtgtgaactcgcccaagtccgcccgggcgagagcgtcgcagtctacggcggagggcccgtcgggctcatggccgcctattccgctctgctgcgcggagcgaaaaaggtgttcgtcgtggaccgggtactggagcggctgcaaaaggccgaggagatgggcgcggtcccgatcaacttcgccgagggcgacccgatcgcgcagatcaaggagcagaccgagggcatcggcacggacaagggcgttgacgccgtcggctaccaggcgatggcgcacggcacggaccgcgaggaaccggcgaccgtcctgaactcgctcgtcggcacggtccgacccaccggagcgctcggcgtgcccggcctctacgtcccggccgaccccggaggccccgacgagcaggccaaacagggcatgcttctcgtcgcgatcggcaagctcttcgagaagggcctgcgagtgggcacgggacagtgcaacgtgaagcgctacaaccggtacctgcgcggcatgatcaccgagggccgggcgaagcccagcttcgtcgtctcccacgaactgcccctggatcaggcaccgtcggcctacgacaagttcgacaagcgcatcgagggctacacgaaggtggtgctgcacccgtagccctgtggaccgacacggcggccccggccggattcccggccggggccgcatgtgcacgtggtcgtgaagggcggtcgcctacgcggcgaaaggctccatgaggcttcagccgaacgatcgtcctcatgggcgatgggtgaggcccggggacactgtccccttcaccaccacgcctcctgcaaccaacggcacccggcgattgttccccgcactcccccggcgccggcggcgctcctcctcgggacccgcggcaccggcattccgtgaacgtgcccccgtcccgcctcggcctcggcgtcggctctgcgacacggttcgccgtttgcagaccgtaggaccggatatccgagcggtatggctggagcaagtaacaagacgacgaatggacagtcgccgaccgcgaacgcgcgagcggcgaagaagaccgtggccgaaggagccgcaacaccggcgaaggaggcgcagcaggccgccacggaggcgacgaagaacgccggggacgcggcgggcgccgtcggccgcggcagcaaggaagtcctggcgggcctcggcggagcggcgtcggagaaggccagggaagcggccaggacggtgcagggcaccgtcgtctcggccgccgaacagaccgtcggcaaggccggcttggtctggaccctcctgaaggccaggaaggtcgtggcggccgccgccggcgcgggaaccgccaccgtggttctctgctcctacacactgggccgccgtgccggtctacggcagcgtggaccgctctcccgtctcagcggcggccgtctttgagcggcagaacccaccgaggcagtcctgtgcgcgggcccgccggagctttccgctccggcgggcctgccgcttggggggaacggagagttggtggttgtggtgggaatcgagtccggtgggtgctcgagcgtcagctgatgcctccagcggctggacgacgaccccgtacccgccgcagtgagtgcccgggaagcccgctgtgttggaggtgcgcggttccctgcgcggacaacggacctcccggccacagagtgctcctgccccgttcccgcaccacccgtgcaccaagcacggcattttcacgcaagaggcacacgaacgccgggcggccccagacctgaatgtctggggccgcccggcacttccgggtgtgactactgctcgctaccagcgataccaacggccgcgaccaccaccggttccggcggaacgcatgacgaaaccgagcaaccagaccgccagcacaatcacggccacgatccacagagccttgagcgcgaagcccgcgccgaagagaaccagagcgagcagaagaacgagaagcaggggaaccatagttatcaacctccaaagcaccgtgtgccctggtaacaccccgccatgcgcccaaagtttatgcgtttcttatccttcggcgcgggaatgtggcaccacccacaacgcctcaccctcgttcagtccttggtgccggtgtgcggggggtgagcggcgtcgttgtgctgcgcgtcgaagcgtcgccgggccgcctcgatctcgtccaggtaccggcgggtccacgcgcacatgccgttgaccgtgtcgcgcagcgccccgcccgcctcggtgaggcggtagtcgacccgtggcggcacttcggcgtacaccgtcctgtgcaccagcccgtcccgttcgagcccacgcagggtctgggtgagcatcttgtggctgatgccgtccaccgcggtccgcacctcggtgaaccggagggtctgctcgcccagcacattgatgatcagcagcgcccacttgttggccacaccggagaagatctcgcgggccagggagtcggcacgcgtcacgtctttgtcctcgggcgcgcgcctgacctgcttggtaaccacgaggttcccctctccccgaaaagtgcgttcttccacgtcaaaccatagtcacctacggtttccgactgaccagaagagatcattgggccgcccggtacgccggctgcggccgcccgacatggtatggagagcccatgagcatcctgaagacgtacgcccgcctgtggaccgacagcctcgacagcgcgctgccgctcctcacggaactcaccggcgtgcagccggacctgcggctggcgtttcactccgtggaactggccgccatcggcgacttcctcgtcatcgcgggcccggccgacgagcgcgcgaagtacgcgcacgcctccgccaccgtggtcgtcgaggacctcgacgccctcgccacgaccctgaaggccgccgacgccaccatcaccactcccacgacgagcggtccgacgggacggttcctctacgcccgccacgccgacggggcagaggtcgaatacgtcgagtgggtcccggagttggtccgccggctcatccaccagggatccctcgcacgcaccacgcctcgcacgacatcgggtaaggccgagcccgaaagggggagcagcgtttcgagctccttggggtgaacggggaggggcgcacaggactgcccgcgtctcatgacacacgcacgtggtgcgacaaaaagaaccccacccctgaacattcggggtggggttcgtatggagcgccgggcaggccttgcacctgcatctccccgcaggaagcggggcgtctttccttggaccaccaacgcacagctcaccaccgggagttccggcggcctgctcaagatcaagcatagcgcagtttcaccacccggcggtccgggctccggtgagcaccacgctcggcggcccggaggccatctccggatggcaccaccctgtgccgtcctccgtcctgggcgacggtgctctcgccggacacctgaagactgatgaacagcaccggctcgtcgtcggccttggtcagccgtggagtccgatgcaccgtggcggggttggcccgcacggtggtgacctgtagagatccccacctccgtgatcgtcgccggtgccacgacgggcacacgttgtcgcatggcaccatgcgtgaccggaggcacggacgtgtgccaccgggcaggaagcccggtgggcacacgcttgccctgcccggttctagaagggggtcagagtcaggttgatgcccgtgggcgcggtgtcctgaatgtacgaggcgaagtcggcgacgtcgtcgaaggcgaagccgtacgccttgccgtcctcggtggccgcgtgaatggccttcgcgtagtggttggcgagggccgacccgtagaaggcggcgggatccgtagtgggctgcgcggagtcgttgacaagggtggaacggttgaagccggcgccgaggacggcggcaacagggccggtggtcccgtcattgggggcggccagactgccgtcgcagaagaacacgtcgcgggtggacggcttgctgaaggagaccgaggccgggccggtgaaggtcagcttgtccccgcggacccgaccggtgaaggcaccggcgttcgtggtgacggtcaggtccttgcctgtatacgtgctccacacctcgtcgatgtacggggcgaagtagtcctcggcgaagatgccggcgtccaggccgtgtcccggggcgatgacgcgcaggtcgtccaccaccagtcgctcgaactcggggaccgacttgaccgcggcgaagactcgcgcccgtccaccgtcacgcagagtccccgtggtctggtccttggtgccggtcagccggatactcagcgggacgctgaacatgtcgaccatggtggtgttgcagaacatccccgctgagttgtgggtgaactcggcgcagtcgtgcaacacgcgatagttggggtccgactccacccacccggcggggtactgcagagcggcgttgccgttgccgtccgccaccgccttcaacttcagcttgtcaccgagcgcgacgtagatgcggccggacatgtacggcagtgacagcctcgtttcgccgctgccggacagggcgatggcgtagtcggtaaagccgtcggcgccgttgtccgcgagggatatcggagccagggtgccctcagaggtaacccgaacctgcttaccgtcctcgtttcccacgatgtagaggtgcaccgaggagttggcgaacgatccagtcctgttgacgatcgtcagcgggagcgcaccggccgcacgtggggccgcgcccccgttgtccgaggccacggtggcgagggcgtgcggcgctcccatggcggccgccgggacggccacggccgttccggcgagcgcggcgagcagcttgcgacgggagaggtcgcgctggtgacggggcgtcatgtggggggctccttcttgcgtgcgactcggatcgggcgtggggggaagtggacgcgtcgggaagcgaaggggaacagcgtccgtctgagagcgctctctgaacgctccgcagtcttcgccgacgggccccgatgctagcccgacaccaccccagggaccacccgccccccgaggagccaaaatctctctcacctgcggttatttgactctgcgtccgatgaacaagattgcttaaggcgtctttaaaccgctcttaaacaagcggcatccaaccccctgcgtcaggcgacccggcgccgcctggccagccaggtctgggcgatgatgaccaccacgaggaagccaccgctgaccacctgctggtaggcggagtcgagtgagccgatctggttgatgatgttctggatcgtcttcagcagcagcacacccaccagggatccgctgacgaagccgaggccaccggagagcagcgtgccgccgatgacgacggcggcgatggcgtccagctccatgccgtaaccgaggatcgtgacgccggaggcgagccaggccgcgttcagggcacctgccaatccggcgagcagcgcggaaagcgtgtacaccgtgatcttggtgcgggcgaccggagctcccatgagagcggcggcgtcctcgttgcccccgacggcgtagacgttctggccgaagcgagtgcggcgcagggcgacggcacccgccaggaacagcgcgccggtgatccacaccggcgcgccgacgcccagcagtctgccctggccgaggtggacgaagaccgtttccttgtcgaccagatacgtggtggcgccttcgtcggtgatgttgagcatgagaccccgtgcggcgagcatcgcggcgagcgtgacgatgaagggggcgagccgggtcctggcgatgagcagaccgttgacgcatccgatcagaccgcagaccgcgagcggcagcagcagggcgaccagggcgccgtaccgcgagccccaggcggcgagtacgccaccgagggcgaagaccgacccgacggacaggtcgatgcctccggtgacgatgacgaaggtcatgccgagtgcgaccacggccaggaacgacgacgtcatggccaggttctcgatgttgtcgccggtggcgaaggagtcgaaggagaacgaggcgacaagtgccagtaccaggagggccaccagcgcaccgtgctgctgggccagggcgctgagccgctcgccgcggacgacgccgctccccctgccggcctcgacaccggatgcggacatggcgggttccttcgtcaagtccttggtgatgctcaccgcttccccctctcacgtgccgcgtagacggccaggatgatcaccacggcctgggccagctgggtccaggacggggacaggtcgtgtttgatgagggtcgccgtcagcagctggatgagcagggcgcccgcgacggtgccgccgacgcggacacgtccgccggtcaggggcgtcccgccgacgacgaccgcggtgatcgccgacagctccatgagctggcccagtgacgtcggatcgctcgcggacaggcgtgcggtggagaggaacccggcgacggcggcgagcacgccggagcagacgtagacggtgatcaggacgcgccgtacgggaagcccggcgagctgcgccgccggcctgctgtctccgatggccagcagttggcggccgaacgtggtgcgccgcacgacgaaggcgaccacgaccgcgagggccgccgcgatgagcacgagatacggaacgccgacgacgtcacccgagccgagggacagcagcgtcggatcgcgcacgtccttgagctgcggcagcatgacgagtgccagaccgcgggtgccgaccatgagggccagggtggcgacgatcggctggacgccgacgaacgcgatcagggtgccgttggcaaggccgatgaccacgccgccgacgaccacggtgagcagggccacccaggggccgtagccgaggtagagggacagcagcgaggtcgacagggccatgacggatcccaccgacaggtcgatgccctcggtgccgatggccagtgccatgccgagggcgacgaccaggacgggggcgacctggacggcctgggtgcggaagttcgcggcggacaggaagtggtcggtgaaagcgacgttgaacagcagcaggaccacgacgcccgcgtagacgccgtattcctggagccaccgcacggccgccgcgcggtccgcgggcagggcgttgcgcagggcgacgtcagccatgggtggcggcctcctcctcggtggacgcttcttcttccgccgcttgtgcgatggcccgcatcagccggtcggccgtgacgtcgtcagcgcgcagttcggcgatggccgcaccgtcccggaggacgacgacgcggtcggagccttcgatcagttcctcgatgtcggacgagatgagcaggacgcccaggccgtcctcggcgagttcgtcgatgagctgctgcacctcggccttggcaccgatgtcgatgccgcgggtcggctcgtccagaagaagcaccttggggttcatcgcgagccagcgggcgagcagcaccttctgctggttgccgccggagagttcgccgaccttctggtgcggactggacgccttgatgcgcagccgcttcatgaaggtgtcgacgacggcgtccatgcgggactcggcgaccaggccgtagcgggagagctggggcagggcggccagggcgatgttctcccgcaccgacagccccggcacgatgccttcggacttgcggtcctcgggcaggagactgatgccggcgcggatggccgcgacggtggagccggtgcgtaccgggacaccggcgacggtgacacggccgtcggcgagtgccagcgcgccggcgacggctttggcggtctcgctgcggccggaacccagcaatccaccgaggccgagtacttcaccggggtgtatttccagggagacagcgcgcagttggtggggccgggtgaggttttcggcgcgcagcaccggctcaccgcccgtgtcgtgcgtaccggagaacttggtcgtgccctcgctgcgcacctcgccgaggtcgcgtcccagcatgtacgagaccagggtgagacggtcggtgccggcgagcgggccggtgtgcacatggtggccgtcgcgcagcacggtgacgctgtcgcagacggcgtacagctcctccatgcggtggctgacatagaccacggcgatgccctggtcgcgcaggcggcggatgacgccgaagagggtgtggacctcgcgtggttccagcgacgatgtcggttcgtccatgacgacgacgctcgcgtcgacggccaccgcgcgggccagggcgaccatctgctgtgctccgacgccgagttggcgcagcggtcggcggacatcgacgtcgaccccgtacgcggtgaggacctggtgggcctccgtgtgcatgcggcggaagtcgatcagtccgaggcgggtgcggggctcgcggccgagaaagaggttgcgggccacgctcatcagcgggatgaggttgacttcctggtagatcgtcgagataccggcgtgctgcgcttccagtggtgtgccgaaagcgacgggctcgccccggtggaacaccccgccctcgtcggcccggtggacgccggtgaggaccttgatgagggtggacttgcccgcgccgttctcgccgacgagcgcgtgcacctcccccgcgcgtacggagaagtcgacgtcgtcgagtgcggtgacgccggggaagcgtttggtcagtcctcgtacggcgaggacttcagcggatacgggtgacgcggtcaccgctgacctcctgggactcgttgcgtcgaggccggtgcggcgggccgatggcgccggccgctgcctgcccgggcggacgtgtggatgtcggtacgcccctggatgtcagtacgccttgccgatgtcggacgtggcgttgcccttggtgtaggcgctgtcctggatgacgatgtcctggccgaccttggcgcccttggtgaacgagtcgagggtctggaaggcgagcgggccgaagcgggggttggactcgatgacgccgtcgatccagccgtccacgatgccctggactgcgttgcgcgtgccgtccacggtgacgatcttgacgtcgccgggcttcttgcccgcgctcttgagagcgttgacggcaccgaggcccatctcgtcgttctcggcgtagacgccggtgataccgggcttggactggatgaggttctcggtgaccgactggcccttctcccgggcgaattcaccggtctgcctgaacacgatcttcaggccgggggccttctcctggaggcggtcctcgaagcccttggtgcgttcggtcgtcacgttgttgccggcggcgccgagcaggatggccacctcgcccttgccgcccgtcgccttgatcatctcgtccgcggcgcgcttgccctgctcggtgaagtcggagccgatgaagctcacatagtccgtgcagggggttgcgttgatctttcggtcgacggtgacgatcgggatcttcttggccgcggcctggcgcagtaccggctcccagccgtcggagttgagcggggcgatgacgagcaggtcggcgcccttggcgatgaggtcctggacgtcgctgatctgcttggagaactgcgactgggcgttggcggtgagcagcttgacgccgcgcttgccggcctcggccttgagggaggcggtctccgcgatgcggaacgggttggcctccttctcggactgggagaagccgaccgtggcggtcttcagatcgagcttcttgccgccgaacgtggcgatgtcacaggtcttgctgtcggccccgggagtcgcgacgacctgactggaatcgcccccggcggcagagctgttgctgccggaggcatcactctcggacttggtgcacccggtgcacaacgcgaggccggcgaccaggccggcggcaagcagagacgtggctgacgtacggcgagacatggctggcatacggcgaaaggcagagttcgacttcatgaaatccccataacggcacggcctggcgcaatgaaggcgctcgcgagtgggtcattgcagacgtctgcgcggtgatgctggggagtttttacatcgttggaaggtggctgtaaacccttcgcgcaacggcacctgacgcaacggatccaaggttcccggccgtcgtcctgccgcacgtgatcagcggcggcccagggtgctctcgcgctccaccagccggaatgcggcggtgagttcgcgcccgccgtccgcgctctcgcggcggagcgagcgcagcagcgactccaccgcaagccgtgcgatggcctgcttgtccggggcgatcgtggtgagggtgacggctccgtaccggctctcggtgatgtcgtcgaagccgaccaccgccacgtcccacggaacccgcagtccgcgctcggacagcacccgcatcgccccgatcgccaccaggtcgttgtaggcgaacacggcgtccgggcgcactccggcgtccagcatgcgcgccatggcctcggccccgtcggagcggtcccagccgccggtcgggccgacgagctgctccggcgtcggcacgccggccgccgaaagctcctcttgccagccctgaagccgcaggtgggcggggcggttggcggagtcggtgcgcgcgccgaggtaggcgatacgggtccggccgcggcccagcaggtgccgcaccgcggtgcgggccgcggcgacgttgtcgatcgcgatgtggtcgtagggcaggtcgtactcccgctcaccgagcagcaccaggggcacgtcggccgcccgcccgcgcaggtcttccgcctccagctccagggggctgaggatcagaccgtcgatgacaccggcccggaagccctggctgaccaggatctcccgttcccgttcaccgcgggtgtggtcgagcagcacggtgaggtcctgctcggcggccgcgtcgatgacggccgccgcgagctcggcgaagtaggggtttcccagctcgggcacggccagcgcgatgatgccggtacggcccttgcgcaggtgccgtgccgtcaggttcggccggtagccgagctcgtcgatggcctgctggacacgggcccgcatccccggagtgacgtgctgatagttgttcaccacgttcgagacggtcttgatcgaaacacctgcgcgctccgctacgtccttcagactcacccgcacgagatctcctccgtatcgatgcgcacctggtgaccagggtgtccgccggggcgcttgtcatgaccctggacagcgggccgtggccgtgctgtcatgccaacggccgcctcttccaacgttgtacagctcgttctaccgactgcgacgaagaaccgccacccatcctcagcgaggaggatttgtgcagcatccacgtcagggacccccatctcgccacacccgacgaagcctcggcagatcgctggccctcaccatgacagccgtcctcggcgcggcaggcctggccctgtcccccgccgcctccgccgacagcggccccacgaccgccgacccgaccgaggcccacgggctcaagggcgagtactacactcaatccgcgcccggagctttcgacttcgccgagctgaaggccaccggcttcgatcccgggctcgacttcgactcgctcgagtcccgtctctcggcggccacaggccgggccgacgacgtctccgtccgctggaccggcgaggtcgtccccgagaagtcgggccccaccaccttctcgatcaccggcgacaacggcttccggctctgggtcgacggaaagctcaccatcgaccactgggtcgacgactgggacagggaacagacctcgcagcccgtcgatctgacggccggccgggcctacgacatcaaggtcgagtacttcgagcacttcggcggctccaacctccacctgcgctggacaccaccgggcggcagcaagtccgccgtgccccagtcggcgttccgcctacccgacgggttcgactacaacggcgccctctcggcgaccgtcctcggtgacgggcgcaccgttcgtctggacttcccgcaggccctcgcctccgcccccgccacggtgctcgaccacctcacggtcaccagcggcggcaagtggcccctgagttccgtcaagaccgacccgtccgacgcccgggcgctcctcgtcggcctcggcgaacccgtcgtcggcaacaaggccggtacggccaagggcggcgtcaacgtcacctacgacggcaagggcgccctggccgacaccagcggcacaccggtcaaggccttctggtccagcggacccaacaagtcgacctacgaactgcgcaccaagtgggccgaccaggtgggccccaagaacgccctgcccgagtatccgcgtccccagctgacccgcaaggcctggcagaacctcaacgggacctggcagttcgccggcgccaaggccggcgaggagccgcccaccggcaggactctcgccgagaggatcctggtgccgtatccggtcgagtcacagctctcgggcatcgagcgccatgaggaccgcatgtggtaccggcgcaccttcaccgtcccggccgactggaaggtcggccacggcaagcggctgcggctcaacttcggagccgtcgactggcagtccgaggtgtacgtgaacggcaccaaggtcgccgaacacaagggcggctacgacaagttcagcgccgatgtcaccgacgcgctgaagccggggcgcacccaggaactcatcgtcggtgtctacgatcccaccgacgcgcagggcggcgagaacccgcccctgggcaagcagcgtctcgaccccagcggtatctggtacaccccgtcctccggcatctggcagacggtctggatggagccggtcgcagccgaccacgtcgacacgctcaagctcactcccgacgtcgaaacgagcaccctcaccgtcgagccgaagggggtacgcgacggcctcgccgtgaccgcgacggcgtacgacgggaagaagaaggtcgcaacggtccggggacgcaccggcacacccctcacgctcaagctcgccgagccccgtctgtggtctcccgacgaccccttcctctacgacctcaaggtcgacgtcggcgccgaccgcgtcggcagctacttcgggatgcgctccatcgccgtggagaaggtcgacggaacaccgcgcaccgtcctcaacggcaagcccgtcttcatgatggccacgctcgaccagggtttctggcccgacggcctgcacaccgcgccgaccgacgacgcccttgcccacgatctgaagatgcacaagcagatgggcttcaactccgtgcgcaagcacatcaaggtggagcccgaccgctggttctactgggcggacaggctcggactcctggtgtggcaggacatgcccgcgatgaccgccggggtgaacccgaacgccgcctcccgcgccgagtacgagcgcgagatgaagcagctgatcgacgagcacatcagcagcccctcggtcgtcatgtgggtgaccttcaacgagggctggggccagtacgacgaggcccgcatcgccgaccaggccaaggcgtgggacccgacccggctggtcaacagcatgtcggggctcaacctcggggttgacggcggcaccggcgacgtcatggacgagcacggctaccccagccccgcgctgccgccgcaccccgacggcagacgggccctggtcagcggcgagtacggcggcctcggcctgggagttcccggacacgcctggtcggtgcagatgtcgtacgtggatgtcgaccccgccgcgtacaccgacacgtatctggcccggctcgacgaggttcgcaggcttgcctgccggggcggcaatggagccgtctacacccagatctccgacgtggagggcgagctcaacggcctgatgacctacgaccgcaagatcgtcaagcctgatgtgcagcggctcaggaccgcgcacgaggcactgatcgaggcagtggcgcagtccacgctcccgtgcgccacgtcctgaccccctgacggcgccgggcgacggtccgcctgcccgctccccttccggcgcgggcgggcgggccgtcggccccacccgcacgagcggaccctccgcagggctcttcaccgccgtcgcggcagcgcgcggacggtgggaggtggccgtgaccggcgctgtggcgcgcagggctcttccgtcttatggtcgaatggttcaccgcacatctccggcgcggcaccgctcgcgtccgcgtagcgctcgcgagccgggaggcgctgtccgtacgccgctgtcgaccggacgagacagtcgcattgaatacgaccgctcacggctgtcgtgagccgcggcggactgcgtctctttcgttctgcgccaacagcggtcagagggaagaccggcaccatgggcacttttaccaccgatgacggcacagagattttctacaaggactggggcagcggaccgcccgtcgtgttcagccacggctggccgctcaacgccgacgcctgggacgttcaactgcgtctggtggccgagaacggctatcgcgcggttgcccacgaccgccgtgggcacggccgctcgggccagccgtggaacggcaaccacatggacacctacgccgacgacctctcgcagttgatcggcgccctggatctgcgggacgcggttgtcgtcggccactccaccggcggcggtgaagtggcccgttacatcggccggcacggcagcggccgcgttgccaaggcggtcctggtgggagccgttcccccgatcatgctgaagaccgacgccaacccggaggggctcccgatcgaagccttcgacgccatccgtgcgggcgtcctgagcaaccgcgcccagtactactgggacttgtcggatcagttctacggtttcaatcggcccggcgccgaaggcacggacggggtacggcgcgcgttctggttgtggagcatgcaggtgggactcaaggcggcctacgactgcatcgagcagttctcggaacaggatttcaccgaggacctgcggcgcatcgacgtaccgaccttcatcgcgcacggcgacgccgaccagatcgtccccctcgtggcgtcggcacccaaatctgccgaactcgtcaaagacgcgacgttgaaggtctattcgggggcgccgcacggtctgaccggggcatacgagcaggaattcaacgctgacctgctgaacttcatccgtggctaggcggcaatgtgagggacgaccggtacagatccgcccggggttcttcggcgccggccccgctctcgcgcgggtccggcgtcgcctgagggctgtccctggcgtacacgccgggctcgcgctggcgcaaccgcgccgagttcgtcaacggcagtgcggagatcgtcggcttcctcacgcgcacgtggacacgagagcccgactaccggccggcggtcgccgcccggacgaccatgccggcttgagcgatctcggcttctaggccgttccgtccggagcgtccgatcatggtccggcgcggcgaactgccgccgtcccgcacgtgcgacgccgacatcgcgagtgtgctgggcgtcgccgacgacgtcgtcggcgtcaccaccgcggccgtcatccggcggccggcatcaccttggtcaccttgccttgcgtgtcggcctccaggtagccgccctcccggtagtcgttgctcagatagaccgccatgcccgcaggagtgccgaatacgttgtccggctgccggaccagcaggtagcgggccgtcggcttctcgaccttcagcgccctctccgcacgggcgagcagcgcgggaaccatgtcccactggaaattcttcagactcaccggctgtcggccacccgccagcgtgcccttgatgatgcccttttccacgccgcggtcgacacggtaggtgtaggtgtcgtagcgggtacggctgccctcgaccatgaccgacgccgagacatggtccgggtagacggagaagtcaccgaagctgtcccgtccggtctccttctcgatggccttgatcgaggcccggatgccggccggggtgagcaggtcggtggtctcgctgtccgactcctggtccgtcggcttctgtgtcacggtcgtgggcgctgccggggcgtgctccgtttcgcgggaggccccgggcgacgccgcggctccgtcctggcctccgggcagcgtccgccagaccagcccgcccacgagcgacgcaccggcgacggaggccaccacgatgagccgtgcccgtcccggccgacgggtgaccgtacgcgttccgagacggtcggcgtcggaccccagtggtggacgcgggtccggtacggcgtcccgtggttcccgcgccggccgcctcaggtggtccctcgggttccgcgacgctccgacaagcccggattccgtggtcgcgggcggcggtgccgggaccgggggtgcgagtgggtaggacgtgggctcggccccgggaccggcttccgccacggcggcgagcatccggtcgaaggcctcggcgtccggccgcgctgcggggtcacgcacgagcactcgcgtgagtaccggcgtcaacggaccggccttcacggggtgcggtacgtcgtcgtggagcaccgcggcaagcgtggccagcgtcgtcccccggcgcagcggatggtgcccctcgacagcgacgtacagcatcatcgccagcgaccacaggtccgcaccggggccaccccgatcgcccgtgacgcgctccggcgccatgtagtcgggcgtgccgatgatcgatcccgtggcggtcagagtggtggactcgcggatcgcggcgatcccgaagtccgtgagcaccggactgccatcggggcgcagcagcacgttggcgggtttcacgtcgcggtgctgcactcctgcggcgtgcgccgcacgcagggctgcgagcactccgcgcccgatgtgcgcggcctccgccggggtcatcggcccacgagcgagccggtcggccagcgacccgccgccgacgagttccatgacgatccatgggtaggtgccctcgccgccgtcgacgatgtggtggatcgtcaccacgttcggatgttcgaccctggccagggcacgagcctcgcgcaggacccgttcgcgcagcaggtgcgcgccgtccgggtcgtactcggcgaagtccacgtccggcggccgtacttccttgacggccacgctccggtgcagcagcagatcacgggcccgccacacggtgcccatcccgccgcccccgagccgggcctccagttcgaagcggttgtccacgacccgtctgccggtctccccctcacccatacgcaggagcttaaggggcactgtcgagccccgggcctccagggggccccgcggcgaacgcaagcatcaccgaactgccggtcctgcgcggctactccgacacggctgtgctcaaggagatcgccacccgtttccgtacccgggaggtgcggagcgggcaggtcctcttcgaggccgggcagcccgtcacggaggcatatgtgatcgcccacggccggttcacccgctacaccgccggcaagtacggcgaggaggaaaccatcggggtcgtcaccgacggcgaccagatgggcgacgaggccatcggccagtcggaccctctgtggctgagctcggtccgggccgagacggcgggcgtggtgctcgtgctcccctgggacgtcgtcacggagttcaccgagcgggtgccgtccctcgcggcgcacctagtagggctccgttaggtctgtctcgcggtcctgtttgggggcatgttgaaggtgtggatgcacatgaagtgaaccgtgctcgggcgacgttggcattattcgtggctgacgtgttcgcgtcggtgccgcgtaaggaccagcgggcgaagggcgactgctatctgcgggggctgatgctggacggacggcgtaagtcgatccagccgatggcagagcggctgccggatggcaacgagcagaacctgcagcagttcgtgaaccagtcgacctgggatccggtgccggtgcggcggcggatcgcggagcggatggtggcgcagatcggcccggatgcctgggcggtcgatgacgtgtcgttccccaaggacggcaagatgtcggtcgcggtcgcgcaccagtactgcggggcgctgggcaagcaggccaactgccaggtcgcggtgagcgtgcacgcggtctccgacactgcctcctgcccgctgcagtggcggttgttcgtgccccaggagtgggcgcacgacgcgccacggcggcagaagaccgggataccgccagaggtcgggcaccgggagaagtggcgcctggctctggacatcttcgacgagctggccgggtgggggctggtgccgccggtggtggtggccgacgccggctacgggcagaacgccgacttccgcgacggcctggacggccggggcatcggctatgtcgcggccatccgctcggatgtgaccgtccatccgcacgatgccgagcctttcgcgccgccctggtcgggcaacggccgcaagccccagccccgctaccgcgacaagccgtcctcggtggcggcgctggcgaccggccacgggcggcaggccttcaccgaggtgacctggcgggaaggctcccgcggaccgatgcgctcgcatttcctgtccctgcgggtgcggccggccggggtcaaatcccgacgcctcgcccaggccgccgccacagacgaaaactgctgggacggtgtcctgcccgaggtcacactgctggtcgaatggcccgaaggcgccgaggcgcccaccgactactggctgtccaacctgcccgacacgctctccctcgccgaactggtccgcctggcgaagatccgctggcgcatcgagcacgactaccgcgaactcaagcacggcctcggcctggaccacttcgagggccgctcctggaccggctggcaccaccacgtctccctggtcaccgccgcccacgcgttcctcaccgaacagcgtctggccccaaaagccggtacagcggactcaccctctaccagaccctcgacgccatccaggacctgctgaactgctggagcggcacctgcaccacctgccaccgccccctgcccaaaacatccaccaccagccacaacccaagagccagagcaacctaacggagccctactaggtgtatgaggacaggacgttggtgacggtcatgggcaggcggattgccggtggctggtttccagctgccccgtgtgggcggtggtagttgtagtggatgttccagacgcggagcgcatctgagcgttcttgctcgcattgccagctccgggcgtagaggaattcctcggcgaggatgcggtggtaccgctccactttgccgttgtggcgaggtgtgtatggggtgatgcgttggtgccgtgctccaagcagcgcgcgagcgaaggcatcggctcggtagcaggctccgttgtcggtgacgatccgctcgatggtggtgatgccatgcgctgcgaaccagacgcgagcgcggtgcatgaatgcaatggcggtggtggccttctcgtttggcagtgcctcggtgtaggccagacgcgaaaagccgtcgatggcggagtgcaggtagatgtagccgcgacggccggttcggcgtttctgccgttctgcagatttggcctgcgtgcttccgcggccgtggactcgccagcctccgccatcggggatgcggccggctttcttgacgtcgatgtgcaccatgtgacccgggcggtgggcgatgatctgccgcgctgtgcggttggactccccgtccggatcgatgaaccgacggcgactcagcccgagctgttccagatgtcgcgtgatggtccggcgactgatctggatgccctgggccgagagttcgaaggtgatgcgtgctgcggaccacttgtgttcccggcgcagccgctcgatttgctccactaccgcgccggcgtggctgtcggttggtggcgaggcgcggaggaccggtcgtgcaggccaagttcaccgtagcggcggaaccggtttacccatttcgacgcgcacgctcttgagatccccatctccgcggccacgtgggcgatcgggcgcgacttacagcgttcgacgaggcggcgccggccttcaacagacagcggggcgttgcggtgaagcgacggtctcttcccggtcatcgggtgtgccgtgtgggtgcagagacagcaggaaggtgaaccgctaccagcggcaggaagcagcctacgaggggccccatgcacagtgcgataagcacagtgccgaccccgacggttccacccagaagccagccgacgcaggcaacagcgacttcgatgccggtgcgcacaagggcgacgggcaggtgggtgagccgaacgagtccggtcatgatgccgtcgcgtggtcccgacccaaactgcgcgccgaggtagagcgcgtcaaagaatgccagagcgacaaggccgagggcgagatatccgatctcggcgagtggcccctgtgggttggggagcacagtcgcggtggcatctgcggcgaagccgacgatcgcgacgttgaggagcgtgccaagcccgggcagttctcgcagggggatccatgcaataagcacaagcagcgagatcaggtttgtcgcccaaccgaacgagatatcgagggatttggcggtgccttctgtgagcacgttccagctggctgcgccaagcccggactggacgagcagcatgacggaggccccgtatcccatcaagccgagcaggagctgggggatccgacgtgcctttccggccgcccggacctgggcgaatgcgttcatgtgcggtagtacgggtgggtcgtgacgagccgggacggaggtgtgcgtcgtggaagcgggaggtgccatatggcgagtctcttggccatctggtcctggattccatagccagattggctaggctggttcggtgaaaatcagctcgcacgcggtagcggggatgttggggacctggcaggaggggccggggccggcgcatcaacgtctctccgacaggctgcgtctgctcatcctggatggacgcctctttcttggtgcggccctgccgagtgagcgtgacctggctgtcgcgctcggcaccagcaggaccaccgtcggtaccgcgttccgcacgctggtcgagcacggatacctcgccacacaggcgcgtaccagggcgacggtacgactgcctgatgacaccactcccgagcacttggtcggcacggacgcagagaccatcgacctgtcttttgccgcgccggctgcgcccgtagaaatcctccacgccgcgttcgcgacggctctcgaacagctgccacgtcatttcgagcggcacggctacgaccgatacggcaccgctgagctgcgcgaagcagtcgcccgatggtatcagcggagaggactgcccacccggcccgatcacatcctgatcaccaacggcgcgcagcacgctctagcgcttctgacgcgcgtactcctgtcgccacgcgacaaagtcctcatcgaccatccgacctacccgcacgcgatcacgacgttcactcaagcgcgcgcccgtcttctacccgtcgccgtgacgtcttccggctgggacaccgagcaactccaagcagcagggcaagccgcgaatctggcctacctgatacctgactttcacaacccgaccgggatgtgcatgcccacgagcgtgcgccaacagctcaggctcgcgtgtcccactgtcgtcgacgagacgatgaccgatctggctctggacgttccgagccccgaacccctcgcgctgcacatgccgacggccatcagcatcggctccgtgtccaagagcgtctggggcggcctacgcacaggctggattcgcgcgctgccctctctcctggaacgtgtcgaacaagcccgtcccaccacagacctcggcacccccgtcgtagaacagctcgccacagccgtcctcctgaacgagcaccagacccagcggcccgacacgctccagcaactcagatcgcaacgtgacgccctgtggcaagcactcaccgaacacctaccgaacgtccacgccccgcagccagctggcggcgtgacgctatgggcagccttccccgggcccgtcagctcgcggctggcagccatggcgcctgaccacggagtgaccatcgcggccggcccacgattcgggatcggaggcgcgttcgaacgcaacatccgactgccgtacacgctcccttcgagtcaactagcccaggcaatccgcagactcgcgcaggcagcacaggcactcgcacaaggcgctaccggtactcacaccctcgcgcccatcgcatgagcgtcaacaacgtcatgacgcgcaacacctagatgcctatgccgagcggcagcgacggcccatgaaccgcaagggcgaggccgacgtcccggtgcaggccggtcacgtgggcgagccgtccttgaacggcggcttcgtcgactacgacctcgccccgcgcgaatacgagttgtccctcacccagaccgtgctgcgcgtacacacccgggtcgcggatctctacaacgagccgatgaaccagaccgagcagcaactccgcctgaccatcgaggagatccgcgagcgccaggagtgggagctcctcaacaaccgcgaattcgggctgctgcacaacgccgactacggccagcgcatcagcacgttcaccggcccgcccactccggacgatctcgacgagctgctctgcatgcgccgcaagacccggctcttcctcgcccacccgaaggccatcgcggccttcttccggcagtgcaaccggcgcggcctggtgcccggcaccgcgaacatcgacgggcacgagctgcccgccggcgcggcgtcccgttgctcccctgcggcaagatcccggtcaccccgcagcacaccagcagcatcatcgcgctgcgcaccggggaggccgaccaaggcgtcatcggcctctatcagaccggcatcccggaggagtaccagcccggtctgaacgtgcggttcatgggcatcgacaccgccgcgatcatccgctacctcgtcaccgcccacttctcgctggccatcctcgtcccggacgcggcggggatcctggaaaacgtacagatcggccggaccgccgaatgacgggatggagcaccgaatgagcgcgtcaccgcttcccggtacctcgttcgcgccgccgggaccgcacgacatcgccggcaccgtgcgggcccggcgtggcggggcgatccccgggctcaggtatcggccggcggtccccgccgatcccgcgaaggtcgcggagaccgatcgcaggctggaggcatgggcccgccggctcgacgtgttccccgaggcgtggttcggggatttcgcggggttccagttcggccgggccgtggtgctccagcacccgggtgccgcggacgtggagcgcctcaccgtcgccggcaaactgctgctcgccgagaacatcgtcgacgactgctactgcgaggaccggggtggttcaccgcgcggtctcggcggccggctgatcacggcccagtccgcgatcgacccctaccacggcactcccgaggcggaggagcagtggcggcacggcatgcaggccgacgggccgctgcgctcgtaccactgggccgtcaaggactacgccaccctcgccacgcccagccagacggaccgcctcgtccacgacatcgcccggctgcacctggggtacctcgccgaggcggcctgggcggagacacgccatgtgccgcgggtgtgggagtacctggtgatgcggcagttcaacaacttccgtccctgtctgtccatcgtcgaggtggcatgccaccaacacccaccgctaccacctgccgaactactggtaaccactactgacagtacgtcaaatgcactgcgaggagccactgttgaccaccgcccccgacgccgtcacggcagcaccggtaccgacccagtccacgtaccagtcccgcgtcgcggactactggaacgccgaggagaacccggtcaacctcgaactcggcaagatcgacgatctgtaccaccaccactacggggtcggggccgtcgactactccgtgctcgacgagcccgacccctcgcggcgccacgagaggatcaccgccgagctgcaccgactggaacacgcccaggccgaactgctggccggccacctcagccccctctcccccgccgaccgcgtcttcgacgccggctgcggtcgcggcggcggcagcgtcgtggcgcacctgcggtacggctgccacgccgacggcgtcacgatctccgccaagcaggccgacttcgccaacgaacaggcccgcaagcgggacatcggcgacaaggtgcgctaccaccaccgcaacatgctcgacacgggcctgccgaccggggcgttcgcggcctcgtggaacaacgaatccaccatgtacgtcgagctggagctgctgttcgccgaacatgccaggctgctgcgtcgcggcggacgctgtgcggtgatcatcgggtgctacaacgacacctacgggagggcctcacgcgaagtgtccctcatcaacgcccactacatctgcgacatccatccacggtcggcatacttccgggccatggcccgcaaccggctggtccccgtgcacgtcgaggatctcaccggagccgcgctgtcctactgggagctgcgcaagcggtccgaccggctggccaccggcatcgaggactcgttccggaccgcgtacaagaacggcagcttccagtacctgctgatcgtggccgaccgcgtctgaggccacagaacgccgcccctgtcccgccgccgcggcacgacggcggaccaggtgtacgtcccccgggggagggccactgtccgacagatgtcacggagtggccaacagcgactccaaggccaccgcggtatccggatgacggccgatcagttgcccgcccgccgggccgggatcggctgtctgccacgtaccgtcgcagcccagcaggctcgccaccgcgtcgcacgtcgcggggtgggcggcgagcagcgcgacgttgcggccctcgcccgcgcgcccgcccgggcgcgcggtgtcgggcaacggctgggcccgccacggcggcacccacgcgtccagctcccccagccggccggggaagatccgcccggcttcacggatcaggagcggggcgagctccgcgccgttggagcgcagggtgctgatgagggtgggcagccacggcagcagcaccgggtccggcaggcgtccgaacgcgttcgacactgcctccacgacgaggtcggccagccccggcaccggttccagcgcgtgcacgaatccgctgaggtaacgcggataggcaggcaccaccatggggttgtccagcagttcgtcgcagcgtgtgcgaaggtccgcgcgggagagatgtccgagctgtacctgagccgcccacagcagcgccaccttcgacggctcctgcggatgcgactgcgcgacggacagctccagctgggttcggtcgcagcccagcgacagcgccaggctctccatgccgaacaggaatcccagcatcgccgcgacctggcggacggtggcgtcgtcgtcggtgaacgccgtcggcagcagggtgcagtagtgcgcgtatccggtcttgacgaaggactcgatccacggtggcagcaccggctcgctggtgcggtagtacgccagcagccgccgcacccggcgcagcacctccggtgcgccgtcgacgctgcgttcggccgacagcacctcgagggcgcgggtgcccagctcgtcggtgaggcggcggctgcgcaggtgcagcgtcgcgtcctcgatggcctccaggacggtcgccgtggtggcgtgcggcccgtacgccgtgcggcgcaggcgctgctccaggacctgctcgatgctgacaccctcgtagccgagctcgatgagcgcgcgctggtgggtgcccagcgccaggtcccacgactcctggatcggccgctcgccgagccgccgctcacccatgatgggccgggccgtgccctgcggcatcaggtaccgcagcatccacagcacgtcggagcactgctccagttgcggctgggaggatatgtccagcaacgcccgctggacgccgcgctgctgcaacttcaggttcagcggcgcgagccggtcgtgcacgtcgcgggccagtggtggcagcgcgtcgtaaccgacctggccgatccggtcgccgcccatcatgatgtcgacgaggcggcgcacatcgcgccggcccggcacggtgtccttctcgatgcaggtgaccgccgcgtcctggaagtcgtacggcgtgggtctggcccgatcgcgcatcccggccagcaggatggacgtctcgaacaccgcgatggcgtcagcggtggaggcgagatagccgttgcggcgcgcggcgcgcacgatctccaccgaccagccgagcagttcggtctcgtcgagccggtccaggacgggcggtcgccgcaggaagccggtcagcttgtccgagttcgcggccgccggcacgggggcggccgcgaccgcggtcttcttggccttcgacgtcttcgcgcccgcctgtcccgccaggcggaagggctccacgcgcgtgcgcctgacgttcttcgcccacaccgtcgcggcgatcgacaccgagccggaggcgaggccgaactgcgtctcgatcgccgcgtggctggacggaatgaggccgtgctgccacctggtggcactgcgcggaccgatctcgaaggtgtcggtgccgtggacgccgaactccgcgacgcgactggccgcgtggaaggcaccgcagacgtaaaggcagtccgcggcatcggtgccggtcgcggccaggtgttcgcgcatcctggtccacatgtagcgttcgcggtcctcgtccacgcgcacccggtgggggtcgccgggggcaaggcgtctgaagaggctgccgatcaggagcatgacctggcgataggtgtcgtgatcgctgtcgccgaggggcagttcgacgtactggtgccaccactccgaccagtgccgcaccctgccgtggtgcagcaggtgttcctccagttcggcgaagcgcggccgcaggtcgccgatctccacgccgaccgcgtcgccgtgcagtgcggcctcctcctcgacgggcggtgcgtccgacgcccctggatcggcgccggcctcggcggagtgcgtcccgcgcgagtcccactggaagacatggtccgaggaacggtcgacgaggaccagttcgacgcccggcgtgtccagtgcgtaggcgattgcctggtactcggccgaggcctcggtgatcggtgcgaccaccgacagcggggaccagtcggccgggaagccgtcgacctcggtcgcgaacgcctgcaccgccaccggcagtcggcagttgcgcagttcggtcagcaggggcgccatgtcctcgcacaactccaggtacacgaccttcggccgcttctcccgcaggcggcgtgccatcgcgagcgccgaggcgggcgagtggtggcagacggggaagatctccagtggctcgcgcaccgcgcggtcgacgtcgtcgacgatgccgaggaggatgccctccagggcgtcgggcccgtcggagaacgtcgcggcggcctcctgcaactgtccgcgcagctcttcgaaggtctgcccgtgcgtgccgctcatgagagggtggcgatcgcgtcgcggccgccctccaggaactccggccaggatccgccctcttccttgccgcgcggctcgacgacgccgtgcaggtacttgttgaggatggccaggtcctcgggctcgcgccgggccagtgacccgacgagcgaggaggccagcgtgcgggcggtcagggcgcgctcgccgaagaagttgctgtgcaggatcgcgtcctcgaggacgccgatctgttcggcggtggacagcgcggactccagcttctcgtcgtcgctgccggccgcggccgcggaggcacgcaggtcggcgaagctctgcaacagcacgtcgagcagcgtcggcggcacgtccagctcgatctggtggcgccggagcagttcctcggtgcggaagcggacgatctccgcctcgctcttcctgttcgtcatcaccgggatgcgtacgaagttgaagcggcgcttgagtgccgaggacaggtcattgacgccccggtcacggctgttggccgtggcgatgatcgagaagccgggctgggcgaagacgacgctgtcgctgtccagttcgggaaccgagacgtatttctcggacaggatcgagatcagcgcgtcctgaacgtcactggtggaacgggtgagttcctcgaaccggccgatcgcgccggtctccatcgccgtcatgatcggcgaggggatcatcgactcccgcgactggcccttggcgatgaccatggacacgttccaggagtatttgatgtgatcctcggtggtgccggccgtgccctgcacgaccagcgtggagttgcggcagatcgcggcggacaacagctcggccagccagctcttgccggtgccggggtcgccgatgagcagcagtccacggtcggaggccagcgtgacgatggagcgctcgacgaaactgcggtcgccgaaccacttctgcgagatctcccgctccaggccgtcggagcgctcggagcccaggatgaacaggcggaccatcttcggggacaggcgccaggagaagggcttggggttgtcgtcgatggactccagccagtccagttcctcggcgtacttgatctcggcgggggcgcgcaacaggtcggacatcacagggcctttctaagcgaggaacgtcttgagttcgtggacgagcttgcggatgtggccggagaccaccggcgtgccaagggccttgaagcgctcccggaaccaggggttgacctcctggcgaccggagctggtcaccgagccgaccgggatgaacttcaccccggagcggtggaccgcctcgatgccttcgaacagcggctgggagcggtcgaactcatagaagtccgagatccacaccatcacggtgctccgcggttcggtgatcttcgggcgggccatggccatggcgacgggtccgtcgttgccgcccccgaggttggtgcgcagcagcatctcgaacgggtcgctcacccaaggggtcaggtcgatggcacgggtgtcgtacgcgatcaggtggacgtccaccttcggcagcccggcgaagatcgacgccaggatggtgcagttcaccatcgagtcgaccatcgagcccgactggtccacgacgacgatcagccgttggggcgtcgtcttgcgggcggtgtgccggtagtagaggcggtcgacgtacagccgctcctcctccgggctccagttggtgaggttcttccagatcgtgcgatcgaggtccaggttgcggaaggtccgcttgggtgggacggagcggtccagcgcgccggccgtggcctgcgccacctgggtgcgcagcacctcggccacctcgtcgacgaagcggcggatcagagccttggcattggccagcgcgacgccggacagattgttcttgtcgcgcagcagctgttcgatcagcgacatgctcggggtcagctgtgcggcgagggtgggatcggcgaggacctcacgcaagtgcatccgcttcacgagatcggcctcgatggcaccgagttccgggccgatcgcgggaatcagacggccgaggtcgggcgtcgcaccgcgaccgccggtgccggccggaccggcgcctcgccccgcgcgccctcctcccgggcgtcccccgcgcagttcgcccggccggcagccgagcgctcgctccagccaccccgcgtcggactgccagcgcgacagctgtccggcggtgacggtgccggatccggcggcgaagacgttgagcagcaccttcgacaccagggccgcacgccgtacttcggcggcccggtcgcgtccgtcgtcgtcgggctcgggctcgggcaccatcagaccgtcgaattcggaggccagctccgggtggcgctgcacgatcgagtcgacggaggtccccgggtccaacagcccggacggcagaccgatgtcctcgacgacagcgaggctcgccgactccagcgtcgcctgttcttcgtggtcgaagagacgggcgaggagccgccagtagagaacctggcgacggttctcgtccgagtccgcctccgcgttctgctcgggcgtgtgttcggtcgtccgctcggtcatttcctcagcagccttccggcgcgctcacgcaacaccgccacagcctcggtggcggccttctcggccttggcgcccgtcttgtcggccgtgccgccggcccatgctccggcgtggaccgcgacagccttcttccgcacggtcgtctcgacggcgagcggttggacgctgaacgccccggtgtcccagcgcagcaggccgatgcacgcgttcgacagcgcgacggcctcgggggtcagcgggccggtggtcgggacccggtcggcctcgacggcgagtccgtgtccgtgtccgtgtccggccgtgttgaacgtcagtacgtcgccgtccttgtggacggcgtagccctccaggaacaccggtacggcgatgcccgccggatgccggtgaagcggcgcggtgtgtgcggcggtcgcggtgggcaggacgacgcgggcggtggcgaaggggtcggcgggctcaccggggcgcccttgttcatcactccagatcaggtcgccttcggcggtgatcggcatggcgtggagctccatcgaacggccttcgcctgcggcggccaggagcgacatgtgcgggcggagcagctgccagacaccggctccgacgaccgtgtccggcttcggcaccgagacactggcgcgtaccaggcggggcgcgctgccgtccgcgggctcgaacacggcgtggacctgggcctgcgcggcggtcgcgtgttcgtgcacgtcgacaccgaggggcagcaggcggccggtggcgggagcggtcgtgggcgcgtcggcggcgccgggcaccgtcaggagcatcgcacgcgaccacacatctccccagcggcgtaccggcattcgcttgagggccgccccggggcaggaggcggcgagttcggcggcgaagccgtcgaggagcgtcgccaggcggcgcagggaggggtccgggagcatcgacgagacgacctgcgccgatgccgacaccacctcgtgatcgatgccctgccatccggcgcgcgccagatcgcagagccaggagcgggcggcggccagcaggttcaccatgtgccgctcgccgggcgtcgaggccgtcgcctcaccgcgggtgcgaccgatcacctcgtcgacgcgggtcatgagggcgtcgtggacggagccgagcagtgccgtgcgggcggcggccagggcgacgaagtggtcctcgctcgcggctccggccgccgccttgtcggcggcctccgcgaccctggaggccagcggtgtccccgcgacggcgcaggcgagttggttcaggtcggcggcctgggcgggctggggccggagcaggccgccgacgagcgtccggtcgaagccatcgaccgcggccagggcttcgtcgagcccggccatgggttcggtgagcaggtcggtgcgcatcacgccaccgccctggtcggcgggaaccactgcatctcgggcaacggcgcggtggtcggggcgagttccaggtaggccaggtggcgcaggaaccggctgaagacccaagcggcggccttggcgtccccctgtggcgggttggttccgctcatctccgcggcgatgccctgtgcgctccgctcctcgtccgcgatgtccacacgcaggtagcggacgacgcgctcgacgccgtactgcagcaccgcctcgttgatcagggccttgatgtggttgcagaacgagccccgagcgccgccgcagggacggttgttgttggtgctgcacgcgaacgcgtagctgccggccgcgaccgatgagacgtagacccgctcgatgtccgatccgctggacaccacgccttgcaggcgtccgtcggcaagttcgacgaacgggaccttcgcgagcttgcgcggtcgcgcgggcggtatcacgcgcgccatgctggacttctcccaatccgacaacgcaccatctcctttgcaccaaggggctctcgcgccagagcggcgagacacggctgaacatagtggcgaccactgacaacgccgatcacaggcggagttcacccccgtcgagcgtgctgtgcgacaggggtacgaaccggccgccccgacgaccgggagcccggaccccggtccggacgccgcgcccgcgacgccaagctccgcaccccgataatccgttgccgcccacgctcgcccgagcgatcatcgcgggatgccgaccactcccccggacggacgctccgggatcgacgctgccctggtgagccgtctgatcgcggcgcagttccctcagtggagcggcctgccggtgaccccggtggacatcgacggctgggacaaccgcacctatcgcctgggcgacgacatgacggcccgtctgcccaccgccgccggctacgttccagcggtcaccaaggaacacgagtggcttcccaggctcgcaccatcgctgccggtcgccatcccgccgatcctggcgatgggcgtcccgggtgagggatatccgttcccgtggtccgtacgcggctggctccccggtgagcgagccgatcgagggcgcatcgacgacctgtcgcagttcgcggtctcggtagccgagttcgtcctcgcgctccagcgctgcgacaccaccggcggcccgctcgccggggaacacagctggtaccggggcgcgtcaccggcccattacgacgacgagacccgccgttgcctggccgccctcgagggacgtgtcgacactgaccgtgcggccaccgtctggggcgccgccctcgccgccccgtgggatgggaaccccgtgtggttccacggcgacgtcggcgcgggcaacctcctggtcgcagacgggaaactcgcggctgtcatcgacttcggcacatccggtgtcggcgatccggcctgcgacctggtgatcgcatgggggatgttctccggcgacagtcgggacgcgttccgccgtgctgtcggccaagacgagggcacctgggcacgggctcgcgggtgggctctctggaaaagcctgctgaccctggccgagtgcatcgacaccgatccggaacaggccgccgtcaaccgacgtctgatcggtcacgtgctcgaggatcaccgccgcttcgcccagccaagcgtggcgtagccgatccgggcctgctttcgcgcgtaggtccggtgctgggcgcgggcgacacgatgaccttcgagacggtggcccagagcacccgggacgcccccaccggtgtggacggccgcgttgctccgtacgagtggtgcatcccctgacacagtcgtagcgtcagtacagagacgatcgctggcgacggaacggcacaccgtcctgcgtcagccccacaatccagacttcgccaggcgagcggaccagaggtatgcgcgcggggccatgggtggcggagacaggcggccgggagcggacatgcggacacacacagtgaaaacgttggttacgctctgtgcggctgtatcgctcgcggcagccacgggatcgtcctccgctgccccgccgaccgcgcgggccgtgaaacagcagcccgaacgcaccgtgcttgtcgactgtttctggaaaccgaacgtacgccccaccgacttcatcctcgcctgcggtgacggcaacagccgtctgtcctcgctcaagtggtcgcactggaacctgaactcggcgacagccaagggcttcaacctggtgaacgactgcaagccgtactgcgcggcgggcaagttccactcgtacgcggtcgtcgtgcggctcgaccacccgcagccctggaagaagcgcccgcaggtccagcactacacccagatgagcctcgtctacaccgacaacaggccggacgggttcgagcgaacggtcacctaccccctgtggaactgacgtcgaggggttggcacggtcgcgccgccggtgggcccgcctggcgtggacgcttgtgcgccacgccccccgttcgggtgatggggtgggggcgggggctgttgctcactttcgggtgacggtcggatggcgagtggggtggcgagtggggtggcgcgccgcagcggaggtaggggtcggccaaggctggtaagggtggcgtgtgtactgctgcgtcaacttcatgccgcgccgatatgcgtgcagtgtgcaggtgaggatcacagccgtgtcggtgatccgtaaccctcgcccggtccgggacacggcagcccggggcggcgggagagtggtggtcctcggccaccgggccgggacccgcacaccgcagaccacccgcagcaccgctgtcgtggtctgccagcacccaagggggcacacatgtccgctttgcagtccgtttcagcccgtcgtctgactgccgtcgcactgaccgccggcgcgttgatgagtgtcgcggctctgccggcctcggcagaccaggatcgccagccccaccggcagcgggtggagatcagcaacgtccactacgacgctccgggccgcgacgaccgcagcaaccgctccctcaaccaggagtgggtggacatcaccaacaccggccgccactccgtcaacctcgacgactggaccctgagcaaccgcgacggccgcacctacaccttccaccacctgcgcctggagggccactccaccgtccgggtccacaccggcaacggccgggacacccaccgtgacgtctaccaggatcgccgccacgaggtgtggaacgaccgctccgacaccgcgacgctgcgcaacgaccacggtcgtgtcatcgacacggcgtcctgggggcgcggcagccacgagcggcggggtgggcacgaggggcacggtcacagccgccgctgaccccaccgcgggccggccgaaaggctgaagcaaggccacccgcccgcacgaccggcgtgccacggacccccagtccgtggcacgcctccttttcgcgtggtgcgcatacgcgtgcgcgagcgggttactcggtgtccatggctcggctaccgaaaatcggacacaaggaccacgaggcgcgtcggagcgacaccacggatgccgcccccgcccccgcctccggccgtccggagaccgcccaggagacggacgagcagttcggtccggacgaacaggtggagcaggcagcgccggaggcgccgacgaagctgcccaaacggtcgtggggtgcggtgctcaaaggcagtctgcgggagttcaaggacgatgagctgaccgaccgcgcggcggcgttgacgtactacggggtgctggcgctgtttcccgcactgctggtgctggtgtcgctgctgggcatcaccggcaagtcgaccaccgacaaggtgctgaccaacgtccagaagctcgcccccggctcggcccgggacatcatcacccgggccgtggagcaactgcagaacaacgccggcaccggctcggtcgtggccatcatcggtctggttctggcggtgtggtcggcgtccggctacgtggcggcgttcatccgcgcgtccaacgcggtctacgacattcccgagggccgtccggtgtggaagatcctgcccatccgggtgggcgtgacggtcgtcctgatggtgctggccgtgatcagcgcactgatcgtggtcttcaccggcggtctggcgcgccaggccggagatgccctcggtatcggtgacaccgcgctgaccgtgtggtcgatcgccaagtggcccgtgctggtcatcctggtcacgctcatgatcgcgatcctgtactgggccagtccgaacgcgaaggtgaagggctggcggtggatcaccccgggcagcttcctggccctggtgatctggatgatcgcctccgccgggttcgcgttctacgtcgccaacttcgcctcgtacaacaagacctacggcaccatggcaggcgtcatcgtcttcctggtctggctgtggatcaccaacctggccatcctgctgggcctggaattcgacgcggagaccgcacgtcagcgcgccatcatcggcggccacccgcccaaggccgagccgtacacccagcctcgtgacacccgcgcctgggacgagcaggaccgacgccgcatggacgacgtctgagcggccccgcgagccgagtcgcgacagtatgttcgacgccaccgttccacccggcacgcgccgccacagtcaggggcagtcgacccgacagctcaggcgtggcccagctcctggccgggaaggcatgggcagggccacccatgccttcccggccgggccgggatgctgccggtgcagtggagtcaggccgccaggagggggttaaggccggatgtagggccgggtcatgatctccatgttgtggccgtccgggtcggcgaagtacgcgccgcgaccgccgaagagacggttgatctggccgggttcggtgtggttggggtcggcgtagtaggtgaccccgaccgcctccagacgggcgatcatgccgccgaactgcgcgtcgggcacgaggaacgcgtagtgctgcgactggatcggctcgccggtcttctcgtagtagtcgagcgtcacgccgttgccgaggtcgacgggcaggaacggcccgaacggagcgccgaccttcaacccgagaatcgcggcgaggaactctgcggagagacggcggtcgccggcgtagacggcggtgtggttcagctgggcggtggtcgcgggcagctgagactcgtcctggtactgctgttcgtgtgacatctgcggtgtgtctccgggtcgtgggatccgctgggatggggcgccacacgcgggcgccgggaggaaagacgcggagaagagggggcggggctcttgcccgcctcgcgctcacgccgaggccgggcgcctcactcgtgcatggcccatggccgacccggcagtcacgtgatcgactctagtgtccaccgctggctggggcaacgccgttcctcgacttccgctctgtgtggtcgaggggacatagggtgccgccttgtgaacagacacatatctttcgaacgactgcacaacttccgtgacctgggcggctatacgaccgcggacggacgcgtggtgcggtgggggcggctgttccgctccgactcactgggcaagctcacgggcgaggagtgggaacgctttctcgccctcggtatcggcacggtcatcgacctgcgctacccctgggagatcgacgccaagggacgcgtccccgagcacccggcgttcacctatcacaacctcagcatcgagcaccgtccctacgatcaagcgggcctcgggccggatgtggagaccgggccgttcctcgccgagaagtacatggaagtggcccacgacggcgtcaaggaactgcgtcaggtcgtcgaagtgatcgcggccgtcgccacctccacagacgagtccgtggtgttccactgtgcgtccggcaaggaccgcaccgggctggtggccgcactcgtcctggctctcctgggcgtccccgagtcgcagatcgtcgaggacttcaccctcaccgaactcgccaccgaacgcctgctggccgactggcgggccgaccatcccggccaggaaccgacctggcccggctacggacgtgcccccgccgatgtcatgcgcctgttcctcgacgcgctgacgcaccagcacggatcgatggccgattacgcccgcgacctgttgaggatcgacgagggcctgatcgcggccctgcgccgcaacctgctcgaaccagccgcggaacccgaattgaccttccggcgcgcggaccaccgcgacctgccggaactcgtccgtctccgcgacagcgccgcccgctggcagatcgcccgcgggatcgaccagtggaagccgggacaactcggcgaggatcacttccgggcgcggctggccgacggcgagatctggatcgccaccctcggccccaccggcccgaccgccggtgcctgggaactgtggtgggacgatcccgcggcctggggcccacagcccccgagcgccgggtatgtgcaccggctgatgaccgaccggcgcaccgcaccgccgggcaccggacgcctgatgctcgccgaggccgaacgccgcatcgccgagaccggccggaccttgtgccgtctggactgcctggccagcaacccgcggctacggcagtactacgagacagcggggtacacggtcgtcggcgagcagtcgtcgaaggacggcggcctgggcaacacctacgcggtgacgctgctggagaaaacagttccggaggcactgaccccgcggagcacgaaaccggctcgctgaccgcttccaccaccgccaggtcgtccgaccacgacagcgtgggagcccttgacggcgcccctgcgcgtgccggcgggcccgtgctcgcggtatgacgacctgtggctgtcgtcctggacggccccattcggcccccgcgagggcacccgcgtcgaaggacaggccctcggggcggacgacggcgtacgcgggcgccaggacacgttcgccgtggtcggcgcggtcggccacggcgaaggacggcacgctgcgacgaaagcgttcatcgtgccggggccgacaggtacgagccccgcctcatggcatgtcagacgtcggtgggcaggccgctcacctccgcgatgccccgcagctcctcgtcctgacggtgccgttcaccgatgaagtcggcgatctccctgcgccggtccggatcgaccgcggtgtccgcgtccgtcacgatcctgacgggtcccacctcctcggtctcgatttcgacgatctggttgtccaggcgcccggtgacggcgaccgcgagaacgagggacgcctcgtcccggatctcctgggagacagtgctgccctccgcgccctcgaggctcagctcgatcggacccgcactctggtcctcgaccgccttgagcgccggttcgaccatgcggagcagcagctcgtagtccgctggggccatccgaatgcggagcaggtcgaggtacaggtccacgggccgaccgccctccggcgaaagctctgattcgttcatgagactcgtgtgcccaaatgtgggcgacttgatcgcatctgtgtccgggaccggaagggccgggctgtgcggccgccaccgctcgaaacccgcctgccaggacgaccgcccgcgcacggccacagggtggctgttcgcccgcgaaggccgagcccctgcgccatcggcgcagtgacccagcgaaccagaaccccagtggcaccgcgacacagtgcccagcgacccagtggcacagcggccgggccttcagctcgaccggagggcgaggaggcgccttcagggacacgattcacccgaaaagcgctgttgtgactctccgcgccgagtagcgtccggtcgtgcacagtgccgtttccaaggatggagtcgcgtgcgggaagaaacttgcgaaacggctttaagaaccgctcctccccaggcccctatagggcaacgcgcgccacaccacgtgggcgcatggagggaaggggagagggcatgacgccagaagcgctgtcagcggtactgctgctcgccgtgggaggggtgctgcgcttggccggggacatggtgcggaggcaggccgcacgggcggccgaggagacccgcgcccgcatgctcgtggatctcgtcgggcactgcggcccggacgcggtcctcgtcgaccgacgctcgggaggcgccgtgctgaccgtacgctccggtacggccgcggcccaggagaccggtgctcgtcatcagggccggggtgaggaccgtgggtgacacgccccgaaccgaccgcgcgaacaacgccgacgtcgaacgcgagttccaggtcttctacgcggcccactacgcccaactggtcgcccagggaacgatgttgagcgacagcctccaagaggccgaggacgccgcgcaggaagcctgcatggcggcgatggccaaatgggacacgatccggtccccgtaccactggaccaagaaggccatgagtcgcaaactcgtccgcgaccgtcaaatgcgcagggcccgctggtaccgacggctgctgccgcagtcaccccccgacctggagatcccggtgccgccccgctcctcggtcgatgagcggatgcgcgccctcgacgtcctggccgcgctgcggcaactgccgccgcgccagcgccaggtcatgatcctcctcgccgaatgcgaactggatcaccaggagatcgcggagctgctcggcacgactcccaacaacgtcggcgtgaacgtccatcacgcccgccgcaagcttcgactcctgctcggtcagggctccgagccggtgccgacgggcgactcactggactccgtccgacgcgacgaccccctgtacgccctcatccactccacggccgtgtggctgcgacagggaatccacgccaaacagcgcgcggaccggaaggagggaaaccggtgagccaccacattcgcctggccttggcggccatcctcctggtcaccttctacgctgcggtcgccctcaccatcctgatctgggtgacgctggtcatcctcatgtttgacgtagcgggctccgtctgggcgaccaccctcccggtcaccgggttcctgttctgtgcgggcacggccgtccctgtgtacgcgctgggcgacgcggcgcgccgttcgctcttcctggtggacacaccgtccaccccgtccctggaggtgggccgcggtcgggcggcggcgctgcacgcgctcgtcgatgacctcgccgagcggctagggatctccgagccggtgcgcatccgtctccacacggccgtgggggccgaggcggtggacgaggacacccggttcctgggactgtcggccgggaaccacgtcctgtccgtcggccttcccctgctggccgcccttccgcaccgtcagatccgcgccgtcatggctcatgagctcgcccatctgtcgctgcgtcaccatcgcgtccgcgccttcactctccgtctggaaaccagcctgaccgtcgcccgcgagtccctgatctcgttcggaacggcaaacggcctcgtcggcatgtacgtcggcctcccgcaggcgatgatcggcctctacatccggctgttccggtggcttgtccagcccgtacgcaggcggcaggagctggaggccgaccatacggctgcccggctctgcggcgcgcccacgctcgcggaggccctggccaaccgggccgtggtggagccgctgtggatcgagttccaccgcatgtatctggacgcggctccggacggcgtcctgcctgccgaccccttccgggcattcgcccgcacgatggcggaccccggagtccaggacaggctccccgccctgcgcgcgcggatggtcgaggcgcccgccgcacagaacgaattcggcccgtcgcaccctcatttggcgtatcgcctgcgccgtctcacgaagggacacgagcccgctgccgccatcgcgtgccggcccgacgccgcccttctgcccgatctgctccccggccagatcgccggcctgctggcacgttacgtcggcgcgagcacgcttccgtggcaggactggatcgaccggtgggtggatgccaggaacgcggtcctggtcgagcccctgtgtgcggccgtccgtacgctcgtcggcccggaacatcagccggtcgcgctccaccaggtgctgcacctgctggaggcgggacagcgcatgcccctggcccgggctctcgccgggagggtgccggaggctcaccgggagcctgacgatccgctggccctgctgtcggcggcgctgctcgcgctggtcaagagccggctcacggaacggccaggtcctgggtcgcccctgcctcaactggtgagggacgccgtgttgcagccgagccacgtctcgcggctctctctccatctggcggggtgcggtgtcgacgagaccgcacccgcgcaggacaccccagaaacggggcagcatccctcggacgagccggaacaagccggttactcgacggccaaggtgtccggcggcatcccggaagcgggccgcagggtcatttcctcggtccgcgcggtcaccctcaccgtgctgatcgtcgtggtggccgtgggaggtctgcgctggaccacgcgcgacaagcccgcattcgtacctcccacccgcgtcaccccgacctactcaccggtctacccgatcagccctcccctgccgtcgcagccgtacgctccgctgccctcggcatccgcctaccccttcaaccccgaggatcggttccgcctcccctctcccgtcctgacgccgcccgacttctacctgagtgccactccgtgaccggcgacctccagcggagggtcgctggcggaagcggtcgccgggtgccctggagcgggtgcgggccgggctggtcaggtcaggtcaggtcaggtcaccgcactctcggtgatgatcaagtcggtgacagcgcgcaggcctccccgcagcagcgcgcggcgttgccggtccgcgggggttccttcgcgcagcagacggtgcaccagtgacgccacctcccggctgtcgtcggcagcgtccagggcggggccgatgtggtccatcagctgggacagcacgtcgccggcactgcggcggcggccctcgtagtcgatcagcgagccgctcagtccgtgccgggccgcgtgccagttggcgccctggagcagttcgggcgggcaagacggcaccggcacaccggctttcgcgtcattgatcgcggtggcgacgagcgcacggacgatccccgcgaacatcaccgcgtcgtcagccctcagctggacatccagacagcgcacttcgacggtcggatagcggctggagaggcgcgcctgccagtagagctggccggggtcgaagatcaccccgcaggtcagcagttgctgcacccgcttctcgtgatcggccagatcggcgaagtgcggcggtggtccacttaccggccagcgtccgaagatcaccgtgcgccagctggcgaagccggtgtcgtgccccgcccagaagggcgagttcgccgacatggccaccagtacgggcagccacaaccggatccggttcaggacggccaccccgatctccggatcgggcacaccgacgtggacgtgtgtgccgcagaccagctgctccgcgaccagttgcggagcctgcgcgcgcatggcccggtagcgcgggttgttggtcagcggcggcggcgattcttccttgatcggcggcgtaccacaggccgcgagccggcatccgttgctctcggccgcacgccccaggacgtgcctcagccgcaccaggtggccgcctatctcgtccaggctggtgcacaccggagtggcgacctcgacctgcgcctcggacagctcgggctgtatctcgtcctcccccgcgatcggctccaggccggcagcggctcgtacctgctcggcagccggcatcggaagcctcgtggcggggtccagcagcaggtactcctcctccacgcccaccgtgtacaggctcatgacacggtcacttccgtacggacacggatgagcggcgccgcgcgttcctgctggtgggtgaggtgatcacaaggatgcatccctccgtcctccggaccaggcacggagagagcgttccgcttattggatcgattcatggccttactccctgactcccgcccggcggcggtcctgctgaaggcgatgaaccgagttccccgaacctgcggacacaaccgcaggccgtgctgctctcatgagcgggcgtcgtgacgagacggcgtttgccctggtcagcgggagaggcttcctggaacgccgtcgtcccggcgtcaggaccggacccggcgggtccggtcctgaggggttcggtcctgaggggtcctgtcctgacggcgctcggctgtcggggtcctcagagacgctgccacagggccggtgtggcggcgggctgccacacgccctgcgcctgatgcgactgcaggcactggtacgtgacaccggcgtacgtcacctgcgctccgacctcgtagacccggcccgccgcccagacgccgctctggtcgaccggatcgctgggcgtgtcggtcggagccgtgctcgtcttgagggtgagcccgtacgtgctgaggatcgggttgaccggctggtaataggtcgtcccgccacgtgtgcagtccccggagccgcccgacgtgacgccctgggcctgggagcccgagacgaaggagccaccggagtcgcccggctcggcgcacaccgtcgtgcgggtcaggccgtcgacggtgccctcctcgtaggtgacgctggtgtcgtgctcctcgaccgttccgcagtgccagccggtggtggaacccgaccgacagatcgcggcccccacgatggcctgcaccgagccggcgatcgagacgttctggccggccgcccccgcgacgtcgggagtcgcggtccagtcactgttgacgcccacccacgccatgtcgtgaccggggaagacggaggcctggacggtgccttgagccacctcgttgaagccggcggtcggggcgcccgcccgcccgcagtgccctgcggtggcgaagccctgctggttgcccttggtgacggagaacccgacggagcagcgagcggtgttgtcgatgtagtaggcgtcgccgccccggatgtcgaacagggcgcgcggccggtcctcggacaccttgacgtccaccagcccggagtccacgccggcggctgcgatgagcgcgtccgcggcggcgcggcttctcgcctggagcgtcacccggttggtgcgcacgtcgacgtaccggaccggcgtgttgacggccgtgccgccgtgggccacagcactgtccaacttcttcttggcgcccttgaggtcgtccagcccggtcttcacgaccacggccgtcgcgccaccggcggtgatggcggggatgtccgtggcatgggtggtcgcgacggtgagatcggcggaagcggcgccgtgcacccaggcgccggcgaagtgcttgcccagcgcattctggagacggccggcccgcgtacccgcctccatctcgttcaccaggcgcgtcttggcctgcgtgtccgtcaggtgcagatcgcgctgaagtgcgccgagtaccgcggttgacgggttgccggcaccgagcggctgaacggccgagggcgcgggcgccgggccgggcggctcgatggccgctgccgcgggcagcccggtcagtacgagtgtggcgagcacactcaggccggcacagcctgctccgacgtgtctgtgaaccatcaagtctctcctcgctttcggtgacacaaagacctcaagaccgtaggttttgccgaaagcgactcagagaatgtgtgttggctgcttgttcctcgtatcggccgacacaaggaggccgcccggcggaatgccgggtgccgggtgccggcacaccgggtagtggtagacgaaggccggcagggcccggacctgtcggccccggtgtgacgcgccggggtgaacccggccgggccggacccgctgtccctcagtgagggactcgtggcccgtcagggcggggcgtgatcagccgccgaagccggtgtcgcgttctcccttgcggttacggcgggtcaaaagacgctgggcgcgggtcaggccgctcggcaggtgcttgcgcagggcggcccgggccgcgttggcgcccggggctccgtgcacgccgcctcccgggtgggctcccgccgacgccaggaacaggttggccaccggcgtctccgggcgccccgttcccggaatgggccggaagacgagctgctgatgcagggccgtggtgccaccgttgatggcacctccgtacagattggcgttcagggactggagcgtgggcggggccaggatccgccgcgcgcggatcagggaccggaaaccaggtgcgaaccgctcgacctgtcgctcgacgcggtcggccatgagctcctgttcccgcgcgtcccacgttcccgccagtcctgcgtcgccggcgtcgcccgcgatccggtgcgggacatgggtgtacgcccaggcggcttcggtgccttcgggtgaccgggtggcatccgccgtcgtcatctgcccgaacagcgcgaacggccggtccggcacctggcgcatggcgatctgcgcggcgaaccgggtcagttcgtcgacgccgtccgcgaggtggacggtgcccgcggccgatgcggcgtcggcctgccacggcacggggccgtcgagggcccagtcgaccttgaaggtggcgaagtcccactggaaccgtcgcagatcggccaggacctgggcgggaaggtgggcgctgcccaccaatgtgccgtacagggcgggcacggacacgtccgcgagtacggcccggcgtgcggggaccgtctcgcctccggccgtgcgtacggccaccgccctgccctgccggaccaccacttcgctgacccgctgcccgcaccgcagaacgccaccgcgccggtgcagccgctgggtcagcgccgaggtgagggcgccggagccaccgacgggtaccgggaaaccgtaggtctggcccagcatggacatcagccagccgaatccgccgcttcccgcggcctcgggcgcgaggtcggcgtgcagggcgttgcccgcgagcaggagcctgccgccctcgccacggaactcctcctcgcccaggcgtcgcaccggcaggaccagtgagcgcgccagacgcagcccgccgccggcccggaggcgcgcggccaggcgagctccggcgcggaccggagggaacggcgtgaacagggcgtccagcaggtcggggcgcagccgctcccacacgtcgtgcagctcgcgccacgcggcaccgtcaccgtcggcgaaggtgtcgagggaagcggcggtgtcgtcgaggtcgcgcccgagcacggcgcaccggccgtcggacagggggtgagccagcacccgtggcgcatggctccagcgcaagccctcgcgttccaggtgcagcccggcgagtacgggcgaggcggcggcgaggggatagaacgagctgaagaggtcggtggtgaagtccgggtcgacgccgttgtcatggcggaccgcgccgccgggctcgtcctgttcctcgagcactgtgacgctccagccggcgtcggccagcaggttcgccgcgacgagtccgttggggccggccccgatcactaccgcgtccggcacggtcgcctcccgtgtcgctcgatcgatgtcaccatcgcgcgggcggaggtctgagcggccgcgccgtgtgtgctcttccggtcatgacctgagcggggacgcgccccgggcctgctcggtaccttggtgctccttctcgcacacctctgccaggcgaccgagcatggaacggtgccggagctggatcaacgcttccactcccacgttgtgcagggtgccgccgacccccttcagggggtgctcatcgatgatcacgagcgagtgttcgccccagggccgcacctcgatggcgatccgggccgaaccgagcgggccggcctgcgcttccagttccagttcacgtccgtcgacacatgcgcgtacgaccgtttcgttggtgagggtgagaaagccgatccgtacctcgtagcagatcgcggaatgcacctgcggccactccccgcgcacggggtacgaggcggacgtcccgacgacccagtcgccgtagcgggtgccgtctgccagcacggcccagacatcgcggggacttctcttgatgactcgatggcgtacggccacgaaatgcctccagcgtgtgagatccccgagaagaaggtgaccggctccgacgcccggcccattgcctccggctgtcaaccgatcgagagtccaccggcctacggtccggcgcccgatgtgcggtcggcctgcccaccggcaccgagcagtccagtgggacgtaacacctcacgcgcggccagccggggcagggcgtggcgagacaggcgcatcaccaggggcggcagcgcggcgcgggccacctgagcggccctgagccaagcgggtacgtacaccgaggtgcggcgccgctcgatcgcccgtaccaaccgcgtggcaacggtgtccaccggatagacacggcgggcgggcggcggcatatgcgcacgcaactcacgcagcacggcttgctggtcggcgtcacggatcatgtcggtgtcggtccagttgatgtaggcgatgcccacggcgacgcgctggtacgccagttcggcccgcagcgagtgggcgaaggcctccacgcctgccttggaggcgcagtacgcgctcatcatcggtgcggcgccgatcgacgccaacgaggcgatctgaaggaagtagcccgccgtggtcagcagatccgggaggaaggcgcgagcggtgatcgcgctgccggtcagattgacgtcgatcacccgccgccacgaggcggcgtccgaatcagcgaacggaccgccctcggcgacacccgcgttggcgatcacgaccgacggtatgccgaggcgcccacgcacttcacgggcgacgccgtccagggcggcgtcgtcggtgacgtcggcctcccacgcgatcgcccgggtgcacacctcggccaccagcgcgtcgagcgcgtccttctcatggcccaccagtgccagccgggcgccgcgtcgggagaggtgacgggccagggcggcgcccactcctcgtgcggctccggtcaccaccacggtgcggccgtgcagcgggccgtccttcacagggtccctgtcttcctcatgatttccattcgagcacatttcgctactgaacgtgtcatttcggtgacggaacggacaccccggccgcaccggagcgcataccgcgggacccgcgcattggaggtgccgaaggccaggcccggacggcccgaccgggcgccgcacgcccgcgccgacacaccgcaccggccgtcacccgatcggctccaaccggcgcacatggtttcggtgtctgccggagcggctccggccgtcgcctccagccgatgcggcctgatgtcgcgttgcgtggcccgtgcggggcggattcactgcgacagaaccgcacgtgttctgccgccgaaggtgggagcccatgatgctttcgcactccatcgagcacggcgtcctggtgatcaccctgcacaccgatcccggaatcggccgacgagccgcgctctcccatgagatcaccgatctggtgcacgcctacagcccgctcccggtggtcatcgtgctcgacatgccggaggtgggaagcgccaccgtcagtgccatcctccgggcgcagcgcatgtgccatcacctgggcgtcctgatgtccgtctccacccacagcgccgctacccggcggatcctggaggccaactgcgacacgggcgggacccgcctcgtggtccacgcccgcaccgacgtcgccatcgcggcggcgttcacggcggcggcgtgagaactccggcgcctggcgatgaccgggggccgggcggtgatcagtggttcgggtcggcggcactgatgtcgcccagggccgagtccgcatgccgtgcgacggccacgtctcccagggagacgatgcccaccagccgaccgtcctccaccaccagcatccgtcgcaccgctcgcgcgcccatcaggtacacggcccggtccacgtcgtcgtccggagcgacactgaccaactcggcactgcacgcgctgtacacggtgcgatcgtccacgctgccgccgtcggccagggctcggaccaccaggtcccggtccgtgaccagcccgcgcagtcggccgttctcggcgacgacaacggctccgatgtcctgctcgcgcatcaggcgggcgacctctaccaccgacgtctgcggttccaccatggtgatgtcgctcgtcatgatctcgcgaaccagctgagccatcgttcctccttcgtcggacaagcgcagaagtggccggccggggatgtcgcggcggtccaccctgccgtaccgagggcgtgccccgtcgatgtggtctcggaggtgtcaactaccccgcgccgcacaggacatcggaccgggcgaaaatgtgtggcgccgacgagaatcccggggcgagcagtcgctcagcacgcgcaatggttcggccgggctggtgggaaccagcccggccgaaccagggttggacatgtacttatgcggtcctctcgcagtgccgaagctctgcgtgagctctgtgcgggcccgcgcgagagtcctacgcgtgcctgtgcgagcgccggttgcccgtgacggcccggtagagcaggagcaggatgagcgagccgacgatggcggcgatccacgtcgacaggtcgaagaagccgtcgatcgagtcgaccttgaagatgaccttgcccagccagccacccagcagaccaccggcgatgccgatcagcatggtcacgatgatgccgcccgggtccttgcccgggaggagcagcttggcaatggcgccggccagcaaaccaatcagaatccaggcgagaattcccaccattcctccatgagcgctcggacgtttgttcccctaccgagtgcaccaaaagcggcgaggtaaacccgcgaaccggtcgaatgccgtttcagcgcttggccgaatgcctttccagcgcctgtacgagtcgagttcagcgcctgtacgagtcgagcctgacgtcgtcgaggccggggccccatcaccctccgtccgcgcaggacccatccggcgtcgacgaagtcctggtttcctgtggaacaacagaactgacgcggcggccccggccggaatgtgcgcagttggccgagatcacctccgccgcagaaccgggggtgatcgttccgcggcgtccggcgcgcccggtatccgccattgccgtccggtcacgctgcgcagtcgcccggtcgcacaagccaggctccacccctcccccacccccgcgctgccgtgcataaatgcacgcgtgatcactccgtgacgacgccatcacattccctccaccggacgcacacttccagccgagtggcgttctcggtgttcccggtggggcagacggtgaactcacggcttacctagcctcccgggccatgcgatccacacagatgagacgcctcggtctcgccgccgtattcgccctcgtcctcgccctgttcgggctggcgccctcggcgagcgcggccgacccgggcccggccgacctgacgttcgccacggacagcgccaccacccagccgggcggcacggtgaaactgtcgatgacaatcaccaacaacaagacctacgacatctggttcatctaccagacgatcgagccgacctggctgaccacccagcggcccgacctgaagtacagcttcaccggctgcagcctggccacggccgccggcagcaccccctgttccggcaccggccccgccaacctgggcaccaactacggcgccaccatcccgcccggccagagccgcaccgtgacgctcacgctgcaggtcgccgccgactccggctgcaacggcaacatcggcttctactcgtactactacgccgagttcagcgacagcacgaacaccagcggcggtccggcctacacgcccgagacccgcgtgctctgctcctgacgccgagccgacacccctcccgacgcccgttccgacgccaggtcccgcggtgacctaaaaccgttccagcaccggaatgacagtcgggtctagaccactgccgcctcgtaccggcggactccagctccgcatggagtccgcctcaggccaaacgaccagcgcacgcgccattcccacacgccctgtcgcacacgccccggcgaccgcggcgcggacgttcccgccccgcactcgaccagttcgacacctgcgcttttccgtcatgtttcgcagcaggagcacgaaagctacacagagacatcactatgtgacgcgacggatgcgtcgacgacccgcgtctgaggggggcgaaggcgtcacgcaagggggtgcgtccgctcctagggagcagtgctcaccctgcccggggaggggacttcaccgcatgaagcggaccattcgcacgaccgcgctcacagtgggcgcgctcatagcctcgctcggcttacctgccggtgcggcacacgccgacgccaccacgccccgcatcgatctgcgggtcctggtcgtgagcgacggcggtccgtccacggacgccatcacagccgagctggacgcggccggcaccccgtacaccgaagtcgacctggagcagtccgggcggcccgtgatcgacgccggtttcctggcggacacggttgacggcaggccgcgcgccaagttccaggccgtcgtcctgcccaacgacaacccgttcccggcgaactcggccgagatggcggcgctggcgtcctacgagcagacgtacgccatcccgcaggtcgacgcctacacctacgcgcgtccggaagccgggctccagtaccccgtccacggcggctactccgggaccgtcgacggtgtgcaggcgcaggtcacggcggccggcaaggcggggccgttcggttatctcgacgcggccgtgccgttcgaggacaactccccgaccgtgggcgagagttacgcctacctctcgacccctgccgccggagcggacttcaccccgtacgtcgacgcgcccattcccggaaagtccacccggggttcgctcgtgggcgagtaccggcacgacgggcggcgcgaactcgtcgtcacgttcgtctacaaccagtaccagcagcagttccggctgctggcgcgcggcatcgtggagtggatgaccgggggcgtacacctcggcgcctcccgcaactacttcgccgtccacgtcgacgacgtcttcgccgccgacgaccgctgggacaccgagctcaactgcacgcccggcgacatcgactgcgcgcagggcgaaggcgtccccaacccgatccgcatgaccccgtcggacgtcgactacgccaccgcgtgggagagcagacgcaacttcaccctcgacctggccttcaacggcgtcggcagcgtggaacagcgcgaggagaacaacggcgtcgaccagctcgccgacaagctgatcgcggaccgcgaccgcttccgctggctcaaccacacctacacgcacgccttcctcggctgccggcaggacaccagcgtggtgccgtggaagtgcgccaccaacaccgacggcagcaccgagtgggtcagccgcgccgaggtctccgccgagatcgccaacaaccgcctctgggcccagtcggccggactgcccctggacaacgacgagttggtgaccggtgaacactccgggctgaaactgtctccccagcagcccgaggacaatcccaatctggcactcgccctcgccgacaacggcgtcgagtggctcggctcggacaactcccgcgaacccgaccagcgtcaggtcggtccggccaccaccgtctcccgctatccgatgaacgtcttctacaacgccgggcgggcggccgagcaggtcgacgagtacaactggatctacaccagccgcgcccagggcggcagcggcatctgcgaggaccactccgacacctccacctgcctgacggccccgctggccaccaccacgggctacgccgactacatcgtgccgctggagaccaggatcgacctcgggcacgtgctcgccaacgaccccaagccgcacttcatccaccagtcgaacctggccgaggaccgcatcgcctacccggtcctcgacggcgtcctcgacgggtacaacgacctgttcgcggacaacacccccgtggtgaacctgcggatgaaggacatcggaaccgagttgcaaagacgcgccgcctggaaggcggcgatccaggccggccaggtcaccgcctaccgcatcggcgacacggtgaccgtcgaggcgccggacggggtggcggcgaccgcgaccatgcccaccggcacgaccaacggcagcgccggcttcggcgacgcgtacgcgggcgaggtgtcgggctggaccacgtccgccggccggccgctcaccttcaccctgccgtcgtccgtcccctcactgtccgccaccgtcgccggccaggacaaggcgccggcgacgcgcaccacgccgcacacccgcgtcccggccggcgtgaccgagcaggtgccgtacaccccggagcactgaacagcgcaccgaccgaaggtcccggccgcaccatccgcggccgggaccggcacgaccaccccatacctcggccgtggagcacatcgatgcacgttcaccacggcgcgcgacgccccggcgctacgcgcgtcaccctgctcaccgaaggaacgtatccgcacagtcacggcggcgtgagcgtctggtgcgaccaactcgtcggcggcatgcccgatatcgacttcgacgtcatcgccgtcaccggcaccggacgcgaaccgatcgtgtgggacattcccggacatgtctctcgggtcgcggcggtccccatgtgggggcccgcgcccgaaggccgcgcgccccgtgggcgccgccggaaccggctcgccagcgcctacgagcagttcctcaccgccctgctcgacccgtgtgcggaggacaggttcggcaccgccctctacgtgatggcgcgggccgcggcggacgggatgctgagtccgttcctgcgcggcgaccgggcgatcagcatcctcaccgccgtgtggaaccgacctgggctggccgtgcgcgaggcccggccgaccctgcacgacgccatcaccgccaccgccctgctggaacacgccctgcgcccgctggccacgccgctgccgcgggacggggtggcgcacgcggtcagcggcggtgtcgccgcgctgccgggactggccgcgctcgaacggcacggcgtcccgctgctggtgaccgagcacggcgtgtatctgcgcgagcgctacctcggctaccgcaccgccccctaccgctggcccgtgaaggccgtcgtcctgggcttcttccggctgctggccgaagagacctacctgcgggcggcactgatcacaccgggcaaccgctacaaccggctgtgggaggaacagggcggcgcggaccccgagtcgatccgcaccgtctacaacggcgtggaccccgccgcgttcccgccggccggccccgagccggacgcacccaccctcagctgggccggccgggtcgaccccatcaaggacctggagaccctgatccgcgccttcgccctcgtacggtcccaactacccgaggcgcggctgcggttgttcggcggcacaccgcgcggcggcgaggcctaccgggagcggtgcgaggcgttggccgccgaactcggtcatgcggaagcggtcacgttcgagggccgcgtcgacgacatcaaggacgcctacgccgccggcaacgtcgtgatgctctccagcatcagcgagggtttccccttcaccctgatcgaggccatgtcctgcgggcgggctaccgtctccacggacgtgggcggcgtacgggaggccgtgggcgacaccggtctcgtcgttccgccgcgcgatccggccgccatggccgccgccgcgctgaagctgctgggtgatcccgagcggcgccggtcgatgggcgaggcggcacggctgcgggtgatcgagcagttcacgctgcggcagaccgtcgacaccttccgctccatctacctggagctgtcggcgcccggccggacgacacggcgcgacccatggacgcccgacgccgacgccggtctctcgacgacggccggccccgcggccgcgagaatggggagcctggccggatgagcggaccgatggcactcgaacccggcggcacggaacaggacacgctggccctcagactcgccgaggaccgccccctcgccccgcgaccgccggacgaccacaccgtcgccctgcgcctgccgggccgcggcaccgactccgacgcggtcgaccggctcgccgccgaactggccgaccgcatagggcccgccgtccactcctacgaggtggccgcgctgctggagtcggagggactgacggcggagacgatccaggagcggtacgggcacgcgaacctgttcgcgctcgcctccacgctgtacgcgcgcgtaccgcgtacctaccccgagcccccgcggccggccgacccatggcgcccggaccatgtgcgatgcgcactgcggggagcgctgttcgcgctgccgggactcgcctatctgctcaccgggcggctgtggcacgccgaacgcgacacgtccgtgctgatcgtggccgggctcgtctcctgggcctggggccaggcgctgggacaccgggcctatctgcgcatgaccacgggacggcgggaagcgggccgcacgctcctcaaaggcgcacccctgggtgccgcggcggccacgctggccggggcggtgttcgccggggccggcacggtggccctgatcgcggccgcgcagtcggtgtacctctcggcggccggcgtgctgctggtgctgggccgcgagcggctgctgctggccgcgctcacaccggtgatcgccggtgcggtggtgctgccctggtgggaaccgggccccgtactgcgggccgggctgccgctgctagcgctcctcgccgcgaccgccgcggccggctggtcgctgcgggtcaccctcgcggcctcccccgccccgggcgccacccggcccgggctgctgcggtcgctgccgtacggcctgttcggcctcgccgcgggggtgctggtgctgctggagggccgccggcacccgtacgccgtgatcgtgctgaccctgagcatggggccggccgagtggctgctgtaccgctaccgcgggatgtcggtggccgcactacgggcgaccgcgacaccggccgccttcctgctgcgttcggccggcgtcctcggcttctgcctgctcgcctatctccttccgctgctcccggcggcgctgctcaccggtgccgagccggcccccttgctgctgctcgcggcgaccctgtggaccgcgctgctgctccaggccttcggcgtggcctggccgccggccggggtgtgcctcgcggccgccggcggggccggggcgatcaccttgttccatctcccaccgggcgctgccgcgctgtcgctgtgctgcggcgcggccgccctgtgtctcacggcgtgcgcgctgcggctgctcgggcggcccgccgcgcacgcctgaccgcaaggtccgcatcccgcacgccaccgcactccgctcgacaccgcaccgcgtccggccgaccaccggacgacaccggcccccgacagaacgacatccgacgccttgacaccacggacatcacacgtgcaaccgaccggaaggaccatgagttgacccccgcaccgctcgccgccgtcaccggagccgagggtttcatcggctcgcacctcaccgaggcgctggtcgcctccgggcaccgggtgagggccatggcgcaatacaactccttctcctcctacggctggctggagaccctgcccgcggacgtcctcgaccacgtcgagatcgtcctcggcgacgtccgcgaccccggctcggtccgcgggctcgtcgaaggcgccgactgcgtctaccacttggccgccctcatcgcgatcccgtactcctaccaggcgccgcacagctacgtggacaccaacgtcaccggcacgctcaacgtgctggaggccgtacgggccctcggcacaccccgcctcgtgcacacctccaccagcgagacctacggcaccgcgcagaccgtgccgatcaccgaggaccaccccatcaacacccagtccccgtacgccgcgtccaaggcgggcggggaccggctcgccgacagctatcacgcgagcttcgacaccccggtggtgacgctgcgcccgttcaacaccttcggcccgcgccagtcgatgcgggcggtgatccccagcgtcatcggccaggtggcggccggcgcgcgcaccctcaccctcggcgacctgcgccccacccgcgacttcacctatgtcaaggacaccgcgcaggccttcctcgcggtgggcaccgcgcccgccgcgcaggtggtgggccggaccttcaacgccggcaccggcggcgagatctcggtcggtgacctggtcgggggcttgatcgggcaagggtgaatggacgcctccctcgacgtggcgcggaggacgcgcagcgcatccggcccgccaactccgaggtgatgcggctggtcgccgacgcgagccgcctgaacgcggcgaccggctggagcccggcccacgacctggagcagggtctcgcgcacaccgtggagttcttccgcgacccggccaacctcgcccgctacaagaccggcatctacaacatctgacccgtccggcacgtccacgaaggaggagccccatgcacgcagtgatactggcgggaggcaagggcgtccggctgcggccctacaccaccgcgctgcccaagccgctcgtgcccatcggcgaccagcacgccatcctggagatcgtgctgcgccaactcgccgcggccggcttcaccggctgcaccatcgccatcggtcacctgggcgagatcatccgcgcctacgtcggtgacggctcccagtggggcatggccgtcgactacgccaccgaggagagtcccctgggcaccatgggcccgctgctcaccatgcgcgagcgtctgcccgagtcgttcctggtgatgaacggcgacatcctcaccgacctcgactacgccgacgtcctccggcagcaccgggactcgggcgcaccgctgacgatcgccacgtacgcccgcaaggtacacatcgacttcggggtcctgaccacccaggccggccgggtcgtcgggttcaccgagaagccgagcatggactaccgcgtctccatgggcgtgtacgggctgtcccggaagacgctcgacggctacacccccgggctgccgctcggcttcgacgagctggtgctggatctgctcaagacgccgaacctgccgcacgcgtacgacttcgacgggtactggctcgacatcggccggcccgacgactacgaccgggccaacgccgagttcaccactcgcaagtcgctgttgctcaagggagcctgaccaccgcatgcgcattctcgtcctgggcttcaccggctatctgggccgtcacgtcgtcgagcggctgcgcgccctgccgggcacacgggtgctcggcggcggccgctcggcgggcgcggagttcggcatcgacctcgccaccgctcgcccggacacgctggcgaaggccctggcgtcggccgcgcccgacgccgtgatcaactgcgcgggcgcgaccggcggggacgccgtgaccctcgccgaagtcaactcccgtggccccgccgtcctgtgcgcggcgctgcgggaggcggcgccctccgcgcgcctcgtccatctgggctcggccgccgagtacggccccggcacccgaggcatcagggtgaccgagtcggcggccacccgtccccttaccccgtacggcgccaccaagctcgccggcacgatcacgatcaccacctccggcctcgacgcggtggtactgcgggtgggcaaccccgtggggcccggtgccccgctcaccgggctgcccggccgggtcgccggactgctgctcgcgtcaggcggtgacccggacgcggtgatccggctgggtgacctgtcggcccaccgcgacttcgtggacgtacgcgacgtggcgcgggccgcggtgctcgcggcgacggcaccggcgccgctgccgcgcgtcctcaacatcggcagcgggagcgccgtgccggtgcgcgacctggtcgcggcgctgacacacgtcgcgggattcccggggagggtggaggagaagggcggcggatccgcacgttcggcagaggtctcctggcagtgttccgacatcggcgccgccggtgacaccctcggctggcggccgtcgtacaccctcgacgcctccctggccgcgctgtgggcggcggtcagggaggggccgtcgccccggctggacgggggccgcgcgccgtgagcctcctgatcccgctgtacgtccacccggccgaggacccgggcgcgtggcaccgcctgatcacggcggccgaccgtacgtacgccgtcgtgctcaacccggcgaacggaccgggcacgagccccgacccggccttcgccgcggcggccggcgcgctgcgggccgcgggcgcccgcctgctcggttacgtcgacaccaactatggcgcgcgtacggcggccgaggtcgcggacgatgtcgtgcggcaccgggagtggtacgcggccgacggctgtttcctcgaccgggtgacctccgcaccggccgaacttcccctctgcaaaaggctggtgcagaccgtacggcggctcggcgcctcgccggtcgtgctgaatccgggcgtccatccggcgccgggatacgcccgcctcgccgatctggtggtcaccttcgaaggccactggtccacctacgtgtcggcgttcagcagaccggcatggaccctgcggcacccgccggagcggttctgccacctcgtctatggcgtgcccgaggccctcgtacccctcgccgtgcgcaccgcacgcgagcgcggcgcggccgtgtgcggaccggtcacgggcgaaatccccaacccctggacgcgactgacacccgccctgggcgagacggagcaatgagacatacggggtcggaacgcgcgtgtgtgaggccctgggcaaggcccgaaccggcgccggccggttcgggcctccgccgtgcgcgggctaggtgggggttccagggctgtcggggcgggcggtgtggtcgcggtggccgtgcgtgcggcgggcttccttcatctccgcctcgtacaggtggtcgcggccttcggccagctcgttcagcacgctgcgttcgagagccttgaacggctcgtagtaggtgtcgttgtaggactcgatgatctggaacgtccagtgccccgggatgacgttgcggcccaggatctccttctcgacccggtcggccgaccggtggtggccggctctgcgcagcagttcgaccgcgtgaccgagttccagatccgcaccgccggtcagctgatggaaggagtacaggtggccgcgggcccgctcggtcgtctccagcgccttggacagtgcgcctagggcttccactgtctcgtcgctgacacccgcgggacgctggtggtcacggtccgggccgtcgtgatcgctgttcatgttcacttcagtcccccgcgccgccgcgcgcatgctgttttcgcgacgctcaaggcccggacggcggacgcgagacatggcgtccgactcggtcggcgcagggtggccggccgcgtcgtcgccaggccggtgacgggcgcgtgccgcataatcggcccatgacagtgccccatccggcagaacggtcccgccacgggcggggctggttcgaaaagctggccgaggcggcctccaatctcaccagttctccggtcttctactgtttctgtctgctcctggtgttcgcgttcatcgtggcgcacgcagtcggtctcgagctgacgtggcagctgctgatcggggacatcatgaccgccgtcaacctgctgctgctggccctgctgaagaactccgagcgacgcgccgagcatgccatccagcacaaactcgacagcatcgccgccgcgctgctcgaacagcgcgagggccacagtcgccaggcgcacgaagagctccgtaaagcgatcggcatcgaggacgaattctgaccgcaccgccgggccgggctgcggtccacgcggactggcagtgccgcgccctgatctaccccttgtcggcgcgcgaccgcagtatccagggcagcagataccagcagaacgcgaaccacagcatcacggcaccggccaggatctcggcgagtgaactgggcaggaccgcgtgcaggatgagcaggacggtgcatccgatggtgagcgcgagcagtacgatgccgcccatcatcaagcgcccggcggccgcgacgagttcatccttcatccgctggccggagaggaaacggtggatcgacacgggcgctatgagcgcgccggtcgcagcggccccgaggaggacggccgcgacatagacgccccggtcgaacgttcccagctcccggaacagcggggtgaaggcgacactgagcaggaagccgaacaggatctgcaccccggtctgcgcgacacgggtttcctgaaggatctcctgccaccgccggttgacccgctcctgctcggattcgccctcgtccgcacgtgtaccggagtcgctcgcacgcccctcctgagaagtgcgcgcctcgtcggacgaccgctgtctgcgctcgatcaaactcacggatcttcctccacaatgggccatggccgctgcccgtccggaccggcacgacaatcttcgcctcacacacgtgcccgcattcgggcccgtcagacggggttgcgcagggcctcgccggcgaaagaccggatgacccacggagccggacgccgggctatgcgctcccccaccgcgccacccgtcgcagcacagcgctacgccctccgtccggtaccgtccacagcgtctgaccgcgcacgccccaacgctccaacagggcgttcgcggcgaggaaaccgctggtcgcggcgcgttccatcagcgctacgggcaggccggtgcgcaccaggtcaccggccaccaccagtcccggttcaggggtgcgtacggtcggtcggtcgtggtatccgccgacggggaacagcgggcagtcggcccgccattcgtgccgctcgtcgacgaccgtcgccgcccgcgtctccgggtacacccggcacagctgttcgagcatgcgcttctgctccacctcgcggaccgcgtcctccggcagcgcgtacgcgtggagctccaccacggatccgccggtacgagccgaccagcgggcggcctcgccctcccagcgctccagcacactgacgttgtccagggtcccgtatccgctggtgcccaggaaaccgggccggtcccgggcgacgggccggtcgagccacaggcgcgacaccaggaacggcggagcgttgcgcagccgcgccatccgctcgcgccacggggcgtcggccagggtcggggagcggccggccagggaccgcaggccccccgcgtccagggccagcacgaccgtgtcatgacgccccgtctcctccggcgtggcgacggcgaacccgccgtccctcgtgggggcgacgctctcgaccgacgtcgaggtgcgcacctcgacgcggtgccgcagcagatagccggcgagggggtcccacagggcggtcgggaacggttcgtccggcacgtcgaagagcagtccttcggaggaacccaggaagtagatgtggaacatcagcgccatctcggccgcggacagctccctggggtccgcgaagaagctgcgggagaacacctcgaacgccagatggtgcgcggcctcggggaaacggatcgaccgcaggaagtcgtgggcgctgacggcgtccagacgcgtgtacacatcggggacgctgacgtcgagcaggggcagcgccgccaccgggttcatgcggatcaggtcccgaaggccgaacgtggggctgagcgcgacgaatccgagcgcgctccacggcggggtacgcgggacccggcggaagctgtcgtgcagcccggcactgtgccggagcggatagtcgggcagagccgtcaggcgctccagccgcggatcggtccggcgcagcagcccgcgcaggttgtagtactggcggaagaaggcatggaaaccgcggctcatcgtcaccgtggagccgtcccgaaggccgaccggccggccggagaggcggccgccgaggtccggctgtcgttcgtagagggtgacgcgtactccccgttcggccaacgcggtcgcggccgccagtccggcgatgccgccgcccacgacggcggtcgtggggggtcgtgctccgttgaaccgcgtcgccccgggacgagggggcagcatccgggcgcgccggtccctgccgcgacgtgcggcggccggccgccgggagagggtcatcggccggttgccgtgtcggtgcccgcgcgcctgccgacgacggtgtgggtgatgcccgtctgccaccccggcagcggcagcacccgtacgcagtcgaacccggccgcccggacgcggccggcgaactcgtccgccgtgtcgaactcgacgacgctgcgccacaggtggcggtacagccgtccgtcgccgagggccgtggccacgggcagcacgatgcctccgcatacgaccgtccacaccgttcggtccctggcgcgaccgctgagcgtgtagtcgtggaccgccagccgtccctgcggtgccagcacgtcgtgcaccgcggtgaggacgctgtcgggggcggccgcgttgcggaagaggtaggcggcgaacaccgcgtcgaacggtccctcgacccccgcctcggtcaggcgttccgccggggcgtgcacaaaggtcacgcggtccggccagggcttggcggccgcccgttccagcatgccggcggaggcgtccaccgcggtgatctcggcgcccggcaggaccgcggcgagtgcggcggtcgaggcacccgtaccgcagccgagatcgagcacgcgcgttccgctcccgccgtgcggcagaccgaggcgtcgggcggagcgccgaaggtgggcgtggtagccgggattggccgccaccagagtgtcgtagctgcgggcggcgcggtcgaacgcggcggccagatccgcgtcgcgaagcagggtcatacggtctcctccggcgggcgtgcgggccgtgtccgcgtctcggtcacggcccgggaaagggacggcggggcaggtacggcagctccgcggcggagcggagcatcgggagtacgggggtgtgcaccccgatggagaggtcctcgtggaggtgcgtgcagccgtcgaggaagcgcagcagccgctccatgggcacccgtgagaagagccgcgcgaagaaggccgcaccgccgatccggccgctgtccagggcgcgcagcagcacggcgtccatggcgcgggagcgggcggaatgggccggcggcggcagcgggcggcggccgcggcacagggcggccgcgacggcgcgcgtctggcgctgcacggcggcgaaggtgtatcccgtcgacgggcgtgtcgcacctcccgcggcgccgatccggaagaccgacgccgcggtctgccgggcgaacggcgcgtcggtcatgggaatcacgcccgtctcggtcgagacgatctccaggcccggcaggtggaggatgtctcgcgtgtagtgccgcagggccgcctcgtaggcggaccgcggcaggacggcgggcgagaactccgtgtactccaccagcgcctgccggcggccggtgggcagcacgtatccgaacgacagtcctcgcgggggctggggtgtgcggaagtccatgagctccacggtgccggggtcgaagaccggcagatcggagcggacgaaccagccgtggaaatgctgcaacagcgtggtgcgggccgccgggaggctgccgagcgggcgcgagtcgaagacccagcgggcacgcaccggcagcgggcgcccggcggcggtgtacgcatacacctcggcacccccgggcacgccctccaccgcttcgaccgtcgcctcgacgcgctggacgcccccgctcagcgcgaggtcgtgcgccatcagagcctcgaagtcgtccgaccggatcatcttgtaccgcagcggcgtgatgtcgccctcgatcggccgcccgccgggggcgcggacccgcaggcgctgccatgacgcggtgacagcggcgtcgtaccggccggggccccgctcccagaagcaccacgtgcgcctcggcggcctcagggggcccggcggggcctccagcaggaccaccgagatgcggggcgccccgcggacagggcatgccaggcggtgggccagggacagtcccgcggctcccgcgcccacgatcgcgacgtccgcctccagcacggcgttccctccttccgcgcgagcccatgcgccttgtcggaagcattccgcttcgtgggccggtccggatgcagggcgcgcggtcctgtcggccgtgcggctgactccggcggccgaacgacccggccggcccggtgcggcggcgccgcccaccaccccgtcggcgccgcccaccatcccgtcggcgccgcccaccaccccgtcccggccgtctcagcgctccgcattccctccaatggcgcatccgtgtgcgccgccgacgcggaatgcgttcagacaaggccagctccgatcacgacgagaggaaccgggatgcgccgcagcaaggcgaccgatcaccaggcggccggtccgtcaccgggcccgcgcgacgcgttccggccggcctccgtcgacgaggacgtaccggccgccgtgggccgacttctcgaccgcttcctggcggagcgcgtggcgcgggcggcggccctcgacccggtgttcgcccacgacatcgccgagcgcgtggcgcggttcaccctggacggcggcaagcgcacccggtcccagttcgtgtggtgggcgcaccgggcgtgcggcggaccggccgccggggcggaggcggccctgcgggtcggtgccgccctcgaactcatccagacgtgcgcgctggtgcacgacgacgtgatggacggctcccggctgcgccgcggccggcccgcgctgcacacggacgtgagtgcccagtacgccgacgccgtcctgcccgccccgggcacacgcttcggtgaggcggccgcgatcctcgccggagacctggctctcgcctgggcggacgacgtggtggcggacaccgacctggcaccggacccggggcgcagggtgcgcgaggtgtggagctgcctgcggatggaaatggtggccgggcagtacctggacatccagggccaggcgacctcgtcgcattccgaggcccgcgcgatgcgcgccgcctgcctcaagagcgcgctgtactccgtgcagcggccgctcgaactcggtgccgccctcgccggggcggacaccgccacgactcaggcgttgtgctcggcgggccggtgcgtcggcttggccttccagctccgcgacgacctccacgacgtcttcgaggaaccccggcgcaccggcaagccgtcgggcggtgacatccgggcgggcaaacccacctacctcgtcgccgtggcgcgggcccgggccgaagcggccggcgaccgcggcgccctcgccgtactgcggcgctcgctcggttgcgccgatctgtccgacgcggacctcgcccgggtgcgggacgtcctggtcaccaccggcgcgcgtgacacggtcgaggccgagatcgaccggctggtggcccagggcctgcgccacatgggcgccgcctcactcgcccccgagggacgacgccatctggacgcactgctccgttcagcggccggtgcgccctcggtccgccggcaggcccctgacgcgtcccgctccgagaacgggatgcccgtatcgctgctgctcaccgccacggccgagggggcctcccgatgaacaggacactgcgcgggcgcaccgaccacgtcgtggtcgtcggtgccggactcgccgggctttccgccgctctgcaccttctcggtgccggtcgccgggtcaccgtcgtcgaacgcgatctcctgcccggaggccgcgccggacgtctggtgcgcggcggctacctcatcgacaccggtcccacggtgctgaccatgcccgacctcgccgacgaggccttcgcggcggtcggcgacagcctgcgcgaccgtgtcgacctgatcccgctgcaccctgcctaccgggcccgcttcgccgacggcagcaccctcgacgtgcacaccggcgccgaggcgatggaagcggagatcgaacgcttcgccggagcacgtgaggcggccggctaccgacagctgcgcgactggctcgagcggctgtaccgggcgcagatgcggcgcttcatcgactccaacttcgactcccccctccagttgctgacccccgatctggcgcgtctggcggcgctcggcggattcggccgactggacgcgcgcatcggccgccatctgcgggacgagcgcctgcgacgcgtcttctccttccaggccctgtacgcgggcgtaccgccggcccgggccctcgccgcctacgccgtcatcgcctacatggacaccgtggccggtgtgtactttccccggggtggcatgcacgccctgccgcgggccatggcggacgccgccgcgcaggcgggtgccgaactgcgcttcggacaggacgtcacccggctggagcgggccggtgaccgcatcaccgccgtcgtgacggcgtacgaccggattccgtgcgacgccgtcgtcctcacccccgatctgcccgtcacctaccgcctgctcggccgtgcgccgcgacgcccgttgcggatcaggaactcgccgtccgccgtggtcctgcacgcgggcaccgaccggacctggcccgggctcgcccaccacacgctctccttcggcgcggcgtggggccgcacgttcgacgaactcacccgcaccgggggcctgatgagcgatccgtccctgctcatcacgcgtcccaccgccaccgacccgggcctcgcgccgcccggccgccatctccactacatcctcgccccctgtccgaacacggacatcgggccgagcgccgccgcatggggcgacctggcgccgcgctaccgggacagcctcctgacggaactggaggcccgaggtctcgacggcatcggatccgccgtcgaagaggagtgcctggtcacaccggccgactgggcggcccagggacacgccgcgggcacgcccttctcggcggcccacaccttcgcgcagaccggcccgttccgtccgcgcaacctggtacgcgggaccgcgaacgccgtgctcgccggctgcggcaccacgcctggtgtcggcgtgccgaccgtgctgctgtccggcaagctggccgcagcccgtgtcaccggtggcacgaggcgcacaccccgccgtatgcccgcctcccgcaccgcgagcggaaggacgctttcatgaccgaccgcgaactcgatgcggcgggcatcaccgacccgtcgctgcgcaaggcctacacgcactgccgccggctcaacgcgcggcacggcaagacgtacttcctcgccaccagactgctgccggtcgaacgccggcccgccgtgcacgccctctacggattcgcacgctgggccgacgacatcgtcgactccctggacaccaccgtcggccccgctgtgcgctcggcggcgctcggccgcctccaggagagcctgcggacgggactgcgtgagggacacagcaccgagccggtggtcctggcgctcgccgagacggcccggcggtacgcgatcgaccaccagcacttcagtgacttcatgacggccatgcgcagcgacctggaggtcaccggctacgagacctacgccgacctgcgcggctacatgcacggttcggccgcggtgatcgggctgcagatgctgccggtgctcgggaccgtggtcccgcgtgaggaggccgcaccccacgcggcggccctgggagtggcgttccagctgaccaacttcctgcgggacgtgggcgaggacctggaccgcggccgcgtctatctgcccgccgacctgttgcgcgcccacggcgtcgaccgggacctgctgcgctggagcagggacaccggccgccgggaccgccgtatcacccgtgcgctcaaggccgttgagggcctgacccgcggtgtgtaccgcgaggcggcgccggggcttgcgatgctcgacccggtggcgcgcccgtgcatccggacggcgttcgtgctgtacggcgggatcctggacgccatcgccgacgacgggtacgcggtcgtccaccgccgtgccgtggtgccgcgccggcgccgtgccgcggtggcgctggacggtctcgtacgcctgggcgtggcccgtctgggatcccgcgccgacgcgcggctgcccaccctgcccgatccgtggcggcttcccgccctggtgccgaggtcctcgccccggccggcacatgaggaggtcgcatgacccctgaccgcaccgaccgtcctgcccggcgccgacgctacccgctctcgttgcgcaggcatccgattcgctgggaggaccagcgtccgacctggcgcgacgcgcggcccgccgtgatcgcggaggcgctgaagcgggcgcaggcacgaccatcgggcaactggtacgtcgtcggcgccacccgtgatgtgcgggaggaccgccctctggcgcgcaccgtggccggccttgaggtcgtcgtctggcgggacggcgaagggcggctggtcgccgggccaggtgtctgcccccatctcggtgcaccgctgcgggacagccccgtgcgctgcggcacgctcatgtgtcgctggcacggactcgccctgagcggcacgccgttcgcgggctgggaaccgctgcccgtgcacgacgacggcgtgctggtgtgggtacggctggacgaggtcggcggtgagcgaccgctcgaggccccggtggtaccggccaggcctgccctgtcgggtgccgtgtcggccgtctacgtcggcgtcggaatctgcgaacccgaggatgtcgtcgccaaccgcctggacccctggcacggcgcatggttccacccgtactccttcgtcgacctcaccgtcgtcacgcccggggaaaccgtcgcacctgaggaaggagaaacggagggtgtagagacggggggtgacgaggcggagggcgccgagacggaggacggatttaccgtcgacgtgtctttcaagatcgctggacggctggtcgtcccggtgcgggccgtcttcaccgctccggagccccgcacggtcgtgatgcgcatcgcggagggggaggggcggggctccgtcgtcgagacccatgccaccccgctcggccctgacgaccggggcaggccgcgcacggccgtggtcgaggccgtgctggcgtcgtccgaccgccgcgggttcgccgtggcgcgcgcgatggccccggtgctgcggccactcatgcgcgctgccgccggacgcctgtggcgcgacgacctggcgtacgcggagcggcgccggcacctgcgctccacgggccgcttccccggctgaacgacaggcctgcggtgagccgacggcccacacgatgccgcacgctcacgggggcggcggggtggcgtacctggcacaggcggcggtgcctcaggccttcggaccggagcacggaacgagttccgccggatatgggcgggggagccattccgatgaccggacccccgcgccatgtcggctgcgggggcccggtccactcgtccggctcaaccggtgcggctcacagcccgctcgaccgagatccgttctggtcggtcacgtcggtgaccgaccaccgttggttggatccggagttcggcgtccatgtcgtgacggcggctccgtcggtggtggcctggccgccgacctcgaggagcctgccggtggcggcgttgacgagggtccaggtgccgtcgccggtggtcgacatgatccactgggtggccttgtcacggtggccgcggtccgcctccagcaccggcgcgccgtcacgaacggccaggcgctttcctgccgcggggttggtgaacacgtaccgctgccggttcccggtgtcgccgctgatctgacgcacctgccactgctgcccggtcccggccgcatccgtacccgcggtcctgatgacgagctgggtgccgtcgtccgcgacggtgagggccttgccgctctggacgccggtcagctggtaggtgtgccccttgcacaggagcgcggcgtccttcgcgacgccggacactcccttgacgaggaaggacgtcacggactgggcgggtacggtgaccgcggcccggctgccggtgacctcgacgggggcctgtcgttcgagcttgcctgcggcgctggtgaccacgggagtcacggtcgcgtcgcgggtgatgtggccgaacttggacaggtcgatcgtgacggtgcgggcgctggtggtcttgttgacgtggacgaccgtcgccgcgttgcccttcgtggagaccgcggcggcgctggaggtgtcgtcggtcctgatcagtcggtcgcccggcttgatgtagtgggtgaagttgcgggcggtgtcgaacttcgtgttcgtgtggacggggcaggtggccagggtgtccgcggaggtgcagctgaacgggagctggatgctgccccagttgccgcccttggcggactcaccgccgggcttcatgttgtcgtagtcctcgaccggctgccagaacacccaggccttgggctcgagttcgcgcaggtcgtcgaccatctgctgggcaagcccgaggccgggccgcatgtccgtgaagctctggccgtcgccccagtcgccctcgacctcgctcatccacagcggcttgtccgccgccttggccaggtcgcgcacgctggtccggccgccggtgccgtaagtgtggacgttcatctggccgacgagatcgcgcacgtcctgggggtaggagttccagttctgcgcgaagaggttcgggttggtctcgtccatcgcggagatcttcgtgccggtcttcgccttcttcagggcgggggccagcgcgcggatcaccttctgctggagctccgggccgatgtgagccccttcctgacggccgccgacgggccggccgtcggatcccaggcgcgtaccccaatagcccgtgttgggttcgttgaacgggtcgagggtgtcgaccttgatgccgtgcgccttctccagccgcttggtcgcgcctgccagataggcggcgaagtcgtcgacggagtcggccttgagctggtcttcgctggagttgaagccgcccgacacatagccgctggcggtcatgaaccagggcggggagttgctgaacgtctcccagtggtcgatgtcgttcttgatccggtccacccaccaccgctgggtcgcgtcggcgttggggttccagtcggcggcgtcgtcggcgctccaccagtcggtgtcctcacgggtggtgcccgccggggcgttccaccagccctcgaccgctccgccggcccggaggtagtccttgacgtcgggggcgttgccgccgccgatgttgtagcgggcgatgttcagggcgaggccgtcgtcgtcgaagaggagctcggccagcttctcgcgtatctccgcgggatagtcgccggtggcgttggcgaaccagaccaggctggtgccccagccctcgaatctgtccgctcggtacgaggggtcgggctggaccgtgacggcagcggtcgccgctgccgccggggtctgcgcgttcgtcggtggagcggtgaccagggctgccccggtggccagggcggtgacgccgatggttcccagaagccgtcgtgtgcgggtacggcgtgccaacgtatgctccccactcatctgtggtcgcttcggtggaccgtcgtggcctgagcgccaggacggatggccttcgaacaggtgcggtgcccttcgagggcggtcagcgggtgggctgccgcagaacggcgacatcccggggggacagcaccacggtgccgtcgtcctctgcccggccgatcaggagttccccggcgagtccggtcagcggcaccgtcccgtcggtccggttgaccaggaacagatagcggctgccggcgccgcggcgcacgatcagttcgacgtctccccctacgccgtcgggcagttcactgccgaccgcggcagggccgagcagcttcggcagcagtgcggtgaggccgtccggtcccagccgggtggacacatacgcggccgaaccccggcccaccgcacggcgggtgacggcggggtggccggcgtacgtaccggtgcggtaccgggccaggacctccacctcggggtcggtgacggtgatccggtcggtccacagggtgcccgtggcggcgtcgtccagtgcgaccgtgtcgccgtcgagcagcgggccgaactcctcgacgcggatgccgagcagatcgcgcagggctccggggtatccgcccagccagatgtggtcgttctcgtccacgacaccggagaagtacgtggtgaccaggtgcccgccgttctcggcatagcgggtgagttccttggccagtgccgcggggaccacgtgcagcaccggcgtgatcaggagctggtaccggtcgaggtcggcctgcggggtgacgacgtcggcccggatgccgagggcgaggagggcggagtaccagtcgagcgcctcccggcggtagtcgagcagggaggtggggtgggagtcctgctcactcgcccaccaggactcccagtcgaagacgatcccgacccgcgccggttcacgctcggtcccggcgaccggggccagcgtccgaagggtgccgccgagggcggtcaccgcgcggaagacctcgctgtcgggtccggcgtgcggcaccatcgccgagtggtacttctcggcgcctgccgccgactggcgccactggaagaagcacacggcgtcggcgccgtgcgcgacgtgcagcagggagtcgcgggccaggtcgccgggccgtttggccaggttgacgggctgccagttgacggcgctggtggagtgctccatgaggaaccacgggcgtccgccggctatgccgctgacgaggttggcggagaaggacagctcgtcccggtcctgaggcccgggcgagacgtagtggtcgttggagacgaagtcgatctcctgggcccagtcggcgtagttcatgcccttggtgcggcccatcaccatgaagttggtggtgaccggaacctcgggcgtgatctcgcgcagcaggtcccgctccgcgcgcaggtacgccttcagcgcgtcggaggagaagcgcttgaagtccagctgctgcgtggggttcgggtgggaggcggccagccggggcggcaggatctggtcccagtcgctgtagtactgggaccagaacgcggttccccaggcgtggttgagggcgtcgagcgtggtgtagcgggcgcgcagccagtcgcggaaggcacgggcggcgtcgtcggagtagtcgtagatgttgtggcagcccagctcgttggagacgtgccatgccaccagcgcgggatggtccgcgtaccgctccgccagcttccgcaccaggcgcagggcgtgcgtgcggaagacgggggacgtgggacgccagtgctgccgcgcccccggccacaccgtctcgccggaggcggtcaccgggaggatctccgggtgtgccgtggcgagccagggcggcggggacgcggtcgccgtggccaggtcgaccccgatgccgcccgcgtgcagcaggtccatgacgtcgtcgagccaggcgaagtcccactggccctgggccggctggatgcgggcccaggagaagatccccaccgagacgatgttgacgccggcctcgcgcatcagccggatgtcttcctcccacacctcgcgcggccactgctcggggttgtagtcggcgccgtacgcgaggcgtggcgtgcggtcaccgtccggcccgttcagctgggacaggagggtggagatcatcgtggtccttccggtgtgtcacaagggggcggcgtggggggcttgcctcgactactcgacggtgaagccctgttccttgccgtacttgacggaggcgtcctgccaggacttcagggcgtcggccagcttggtcttcgagatgtacgccttgccgacggtgtcgttgaagatcgagttggcgtactgctggaagggcaggtacgaccagtcgtcggcgacgttggcggccgagtcggcgaagatcttgttggcttcctgcccaccgaagtagtcgaacttggtgttctggaactcggtggactggagttccgcggtggtcgcggggaaggcgccctgcttgatgcgggtctgcacaccgtcgccggcgttcgcgtactcgacgaaggcgtaggcgagttccttgttcttggccagctcgggcacggtgagggagctgccgccgttctccgcgctcgccttgtcgcccttggtccaggccggcaggggggcggctcgccagtcgccagaggctttcggcacgccggtgacgaagttggcgggcatccaggcgccgctgggcagggtggcgatggtgccgtcgcccaggcccttgtaccagtcgtcggtccagccgtagatgggtgcgacgagcttctcgtcgatgagcttctgccaggtgtcggtgtacttcttggcgcccgcgtcggcgaagtcgatcttcaccttggtgccgtcgacctggtagggacgcgaaccggcctgccacagcatgctggtggtcaggcccgcgtcgccggcgtcggcggcgatgtagaccttgggatcggccttgtgcagcttgcgggccgcctcgacgtactcgtcccaggtggtcggcaccgcgaccttgtacttgtcgaagactttcttgttgtagaacagcgccatggggccggagtccatgggcaggccgtagaccttgtcaccctcgctcacggcgttccacgggccgggggtgtacttggccttgagcttgtccgcgccgaagggggtcaggtcggtgaggcccttggtgagcgcgtactgccccagcgcgaagtactcgacctgcgcgatgtcgggaacgcccttctcggccgagatggcgttcgacagcgcggtgtagtgcttgtcgccggaccgctcgccgacgaggttgatcttgaccttggggtacttcttctcgaagtcggcggcgaccgtcttgagcgtgggctcccaggcccagaccgtgaccgtgccgcccttcttcagggccgcctggatgtccccggcggagaccggcttctggtcggcgctgtcgtcgtcggagccgccacaggcggtcgccccgagggcgaggacggagaggacggcgaggccgcgcatcaggcggcgggtcgttctgcgcatggagatgcttccacttcttcgtgggtgggacggggcgagggtgagggagagggaaacaggtgaggctgaggggggtgggcctgagggtgggtcattccttgacgcttccggcggcgagcccggactgccagtacttctgcaacagcaggaacgcgatgatcagcgggacgatggtgagcagcgagccggtgatcaccaggttgaagatcacatcgccgccgatcgtctcggcctgggcgttccaggcgctcaggccgagggtcagggggtaccagtccgggtccttgagcatgatcagcggcaggaagtagttgttccaggtcgcgaccgtggtgaacagcagaacggtcacgatgccgggggcgagcagcggcagggcgacctggaagaaggtgcgcacctcgcccgctccgtcgatgcgggcggcctcgaggagttcgacgggaatggcttcggtggcgaagacccacatcagatacaggccgaagggcgagacgagcgaggggatgatcaccgcccacggtgtgtcggtcagccccatcttgctgaacatcaggaaggtgggcaccgcgagggcggtgcccgggacggcgacggcgccgatgaccacggcgaagacggcgcgctttccggggaaggtgaacttcgccagcgcgtagccgcccaggatcgccaggagggtggcaccgccggccccgagcacgacgtacagcagggtgttcagcaaccagcggacgaagatgccgtcgtcgtaggtgaacgtctggctgatgttgtcccagagggcgaagtcatgggcgaaccacagtccggaggagtcggccagcccttcctgggtcttggtggcgctgatgaccagccacgccaagggcaccagggtgtagagcaggaccaggccggtgagcagggtcagcggcacgctgcgcttggggcgtccgggaacatgcttgcggggcgtgcgcagtcggggcgcgcccttggtcgggccggtggccggaacggatgcgggctgggagtcggtggtgacggggctgctcgtgctgctcatcgggtcacgctcccttgcgcatgccgcggagctgcacggcataggcgatgaccatggtgatcagccccatgatgatggcgaccgccgcggagtagttgtgctgctggccgttgaaggacagtgagtaggtgaagaagttcggggtgtagtccgtcgtgatggcgttgcgcgccaatggccgcaggatgttcggctcgttgaagagctggaagctgccgatgatcgagaagatcgtcgcgatgacgagggcaccgcggatggcggggagcttgatggcggtgatgacgcggatctgtccggcgccgtcgatctccgcggcctcgtacagcgagttcgggatgacccgcagcgcggagtagaagatcagcatgttgtagccgacgaactcccaggtgacgatgttgccgatcgacgccaggaccaggtcggtggagagcgggtcgggcagggtgacgccgaaggcctcgttgatgtccccgacgagaccgaagcgggtgccgtacatgaagccccacatcagggtggccaccacggcgggcaccgcgtacggcaggaagatcgctatgcggaagaagtccttgccgtagaggcgcccgctgtccagggcgagggcgatcagcagggcgatgcccagcatgatcggcacctgtacggccagaaagagcgagacccgtccgagcgaggcccagaactggtcgtcgtgcagggcctgttggtagttgtccaggcccacgaaggtcgtgccgccgatgagctgggtgcggaagacgctgaggtagatcgaatagacgatcggagccaggaagacaaaggcgaagaccaccgcgaaggggcctatgaacccccaccctgtccacgagcggcggtcccgcttcgacggaggccgggccgggggccgtgatacagccgctgagggttgtagcgtcgtcatgtcgttcctcgctcgtccatctcggaaccggcgtcacacgccgtcgcgatgtttgcgtaaacatcgcgctccgaaggaagccgtgagctgttatgtttacgtaaacatctgatggcggcatgtctacactgccccaatgttggtggtcaagagtcgcttgcgactcgtcatgagggagacgcgtgaacacggcggacagcggctcgacgagcgtgccgcgggcactgacgcgcatggatgaacagagcgcccggcgcagacagagtgcgtccatggcggatgtcgcccgcctggccggcgtctcctcgcagaccgtctcccgcgtgtccaacggctacgcgggcgtcaccgaagagacccggcaagaggtcctggcggccatgaaggagctgggctaccggcccaacagtgcggcccgggccctcaagcgcggcgagttccgcaccatcggtgtcatcacgttcaacctttccaccacgggcaacatgcggaccctggaggcgatcgccacctccgcggcgcaggaggggtacgccgtcacgctcctgcccgtggccgtccccacccaggacgaggtgcacggcgccttctcccgtctgggagagctcgccgtcgatgccgtcatcatcatcatggaagtgcaccttctcgatgcggcgaccatctccttgcccccgcacgtccaggtcgccgtcgcggactcggacgccggtgaccgttacaccgtggtcgacaccgaccaggcgggcggagcccgcgcggccgtgcggcacctgttggaactcggtcaccgcacgatctggcatctggccggtcccgaggagtcgtacgcggcgcagcgccgtgccgacgcgtggcgcgccgaactcatcgaggcgggccgcgtcccgcccgccgtggtacgaggcgactggtcggcggagtccggctatcaggcggggctgcggatcgccgacgaggaggactgtacggcggtgttcgccgccaacgaccagatggcgctggggctgttgcgggccctgcacgagcgcggccggagaattccggaggacgtcagcgtcatcggcttcgacgacatccccgaggccggctccttcctgcctcccctgaccactgttcaccaggacttcgcggaagtggggcgactgtgtgtgcagggtgtcctgcggcggatgcgccacgacgcggcagaacacggcaccacgctcgtacccacgaaactcgtggtccgtgacagcacggcaccgcccccttcgcggtagcgctcggcgcctcgggctgacccccacgaggatccggcacctgccgcctgcgcgtgtcgaagggaccgcgcggcgttctgggcgttcgatgatccgcctgaggggcatccgcatgggcggggtcccctacgggaccggcccaggcagggcgtctgaaggaggagttttacgtgaccacctacgtcatcaccattcccggcacgttcctgcgggacccgagcgacgacgtgcgctccgctctcgtgcgactgctgcggccggccgacccgcaccacacctccctggggcagcaggaagacctggatctcctcaccgtcaacgacgacaacaccttcagcatccgcctggaggtgacagccgacgacagccgtaacgcggaagaggatgccaaacggacagccgcatccgcgctgcgcgaggccggattcgctcctgatgaagcaccgctcggcccggccacggtgacaggcatcgacaaccaggcctgacgcgttgccgtgactgccgcgcgcgacggtcggaggttccggcaggtcggcgaacccggcgacgacggggcagggccttccctgtccccccgccctggccccgttcctcccggtaccggtaccgggaggaacggggcgcgctccggcagggccgagggcgcggctcggtcatgtcggcgatccgctcaacagccgtccaccggacgccggttgggggtcgcggaccacgcgacccccttcggatgcgaccccggcatgcggacgccggcctcccggcctgccgcggcagcaggcgctcggcctcccgcaccggcaggccgtccgacgggagactgctgccgtggcggccttccgtgggccccgagggacggcagagaaattgactcgtgccatgctggaaggaatcgcggatcatgacggagagcggggaaaaacagcagcgtgaggacagtgacgcggccgagccggacgggcacctgggaccgattcacagcatccgaccccgggctgctgcggctcatggccgggctgcggaccgtgggtgccatcgcgctcacccttgccgtcctggcccttctccgtgccgatgtcagtcacatggtggccggttccatggcggccatggtcgccaccttcgcagtcaaggacaaacagcggcgcgaacaggcggtcaccctcgcgctcggtctgcccgtggcgctcaccgcgatgtcgctgggagcgctgctcaacacccacgtcatcgccggtgacctcttcttcatcgcgctgatcttcgccgcggtctacagccgccggttcggtgaccgcggtatggcactgggtctgatcgggtttcaggtctacttcgtgtcactgttcgtcagagccaccttctccgcgctgcccgggctgtgcgggacgctcgccatcgcgttcgcctgtagcgcggtggtgcggttcggcctggtggtcgagacgcccgagcgcattctggagcggctgcgccgggcgttccgggctcgcctcgcccaactggtgtccgcccagatcgagctgctcgacgccggccccgcccgcctggagaaggccttggaggacgtacgcctgcacaccgcgcgcctccacgagaccgcgttgatgatccaggggcggctggacgagggcaccagcgacagcgccaccgcctcgctcgtacagcgccgcgtcgcggacgccgagatcgccgccgaacgactcggtgttctgctgctcagcgcccgaagcgccgaacgcgccgacacgctgaccctgcacctgccgaacgcgccgctgccggcacccggcgactggccgcgagcgcaggacgacgtcacggccacactgcgccgtgatctccacgcgctgcgtatgctcgtcctccgcccggtctcgcacgaccgcggccccgcggtggcccatctgcgcaaccggctgctcggctaccgcgacgaagagaacctgccgcgcgcctcggccgcggtccaggacgtcttccgcggcatcggagaggcggcgcgctccgtcctgggcctgcggctggccgtcgacggaccccaggacgagtccgacgacacacccgcgacgacccgctcccgtgaggagctggacgccgaggacgtcgccatcgcgggggccgaggagaaggagccggacgacgacggacccacggggctgaagcgtcccacgacccggtccgccgtccaggtgtcggtgggctcggccctggcgatcgtcggcggcgagttcctttccagccagcgctggtactgggcggtgctgacctgctgggtcgtcttcctgaacacggcgtccaccggagagatcctcgtcaagggctaccgacggctcctgggcaccgtgctcggggtcgtcgccggggtcgccctggcgggcctggtcggcaaccgcacctggctcgcgttcgtactcgtgctgctcttcatcttcgcgatgttctacagcgcgccgctgtcgtacgccctgatgtccttcttcgtcacggccatgctggggttgctgtacacgctcctcaacacctacagccccgaggtgctcgtcctgcgcatcgcggagaccgcgctcggtgccgcctgcggcgtcatcgcggccgtactggtcctgcccgtgaacacggatcgccgtaccgacgaactcctcggcacggtgctgagccggctcggggacgtcaccgacgccgcggtggagcagctgagcggcgggcccgcgctcgatctgctggacaaggcccgggacctcgacacggcactggacgatctgcggtcctccacgcagccgctgacccacccgatcaccccgctgcgggcccgccgccagaccgcgcgctatctcgtggctctcctggagacatgcgcctatcacgcgcgttcgctggcggcgacggccgaactcctgccctacagcaagaccgtcgccgccgatccgcgtctcaagagggccgggcggcgtatcgccgacaacatcggcgtactcgtcgcccgggtcgaggacgagggcagcgaaggtgtggtcgagaccggcgccagcctcgccgccatgctggaggcggacactgagggtgccacgcggcccgaccgggtcacgagccgtgtcctgaggcatttgcaacgcctggacgagggagtggtcggtctcgcccgcccgctcggagtgtcggtctcgtccccggaccgtgagtcctcccggggccgcgtcggctcgtagcgccgggtctgggatcgatgaggcgtcgtcagtcctgctgaccgggtggctgctcggccggggtcttcccggcgaggacgtccgtgaggcgttgcgcgcccagttggacggcctggctcgtggagtcgctgtcggcgccgccgaggccgccgttggtcaggctgatggcgttgtcgccgacgcgtacggcggcgatgtccatggtcagcgtgaacggcgtgccctccagtgcgccggtcgcggtcatctgcagtccctgacggtcgtcgcccgcgctgggcagcgacgtctcgacgacctggaccgtctgtgtgcccacgggggtgtcggtggccgtgaactggtcacacgtcacgggcaccgacttcagccagtcgaacgacttgtccagggcggcgtggtcgtacgcggcgacctcgtagcgcatctgggcgtcgttgtcgctgtccgcgaagcccgtcaccgccctcgaacccgagggatcgcccagcagttcccccgagaccagggcgtcgagcagcttctggcactcggcgaggttcgtcttgcccttgaccatggtggcccgccaggactcagcggccttgctctgggtccactccgagcccagatcggtattggtgagcagcgcggtctgggcctgttccgtggtgagtgcgggcgcggtcgaggccgccggggactccttgaccagcggggaggccgagagctcggcggaagggctggacacggcctccgaactgccccggctgtttccgtcctccgagcaccccgcggtggtgagcagcgcgcctgccgccagggtggagacgaagacatgggctgcgcggcgtggacgacggttcatcgctgatgcctccggagggatcgtgcgtacgggcggttccctcctacgccaccactgggtgaggctgctcaccagcgcaggggagtcgtacggatgtgcgatgtcgggcgggcgcccgcgggatcgcccgcatcccggcttctcccgaacggccgggcgtgtatcggccgttcgggtgtccgagcgggccaccgcacgcacaccctgctcgtgtcacttccggaaagacaccagaaagacaccagtccgacgaggccgcgcgagtcccggacccggtcgccgagcctgcccgacaccgccgcgcgccccgttcacgaggcggacggcgtgtcaccgggccctgggggcagggtcagatgcgccagatcggccggcggagcactggtcaccggccacagcggggcggcctgcccgtcggcgaccgcggccggggcgtcggtcaggttcatgcgttcacgcagacggccgtagaagtccatgggccccaaccggaccgctttcagccggcgcggagccgcgtacacaccgatccagtcccccgggtcgagcacaccgcgcaactgtccgtcgacgctgaccgcggccggccccgagcggtccagtacccgcagtgcgatcggctcgtcgggggcggcgacgacggagcggttgaacgccatgtgcggggcgaccggggtgaagatcagagcctcggcgcgcggcgagacgaccggaccgcccgcggcgaagctgtaggccgtcgagccggtgggcgtggccaccagcagcgcgtcggcggagtaggaggccagcagccggccggcgagatagacgccgaccgacacctgccggtccctcgccagcttctccaggacgatgtcgttgagcgcggtgacgtgcagcgcgatgccccagtcatcgccctccgcacagtcggtacgcacccgcgggggcggcaggagggggccccgcccgtatcgcagcagagcttccatgccggtgggcacctgtagacgacgggacgcgcggagcgtcagcagcatgcggctctcgaccgtgatccggtcctcctggacggcctccagcgcctcgcacacagcggcggcgggcacctctgtcaggaaacccacccggccgagatcgacgccgaggaccagggcgtcattctccgcggcgagccgcgcaccccgcaggaacgtgccgtctccgcccagcgtgacgatcagatccggattgcccgccgccgcgacctcctcgcgggcactgtgccgggtgtcgtcccgccacacgtcgatgtccgcacagtgcacgccgcgttccgcgcaccagccacgcacgatcctcgcggcgtccccggcctgcgcacgacctccgtgcatgaccaggccgacacgcgtcacggtcacatccgcctcccggtcggctcaaggatgaacgccaccggcgcacgccgggtcacggcaggatcgagtcgacgtatccgccgtcgacacgcagggctcccccggtcgtggccgaagcctgctcggagctgaggtagacgaccatgttggcgatctcctccggctcgatcagccgctggagcaaggactgcgggcgccgctcacgcatgaaggtccgctgcgcctcgtcccagggcacctcccggtccacgagctcgtagacgaagtcctcgaccccgccggtgtgcgtggggcccgcgatgacggaattcaccgtgaccccggtgcccgccgcctgtttggcgaatcctcggctcaccgcgagcagtgccgtcttggacatgccgtagtggatcatctccgcgggcacggccaccgccgagtcactggcgaggtactggacgcggccccagccacgttcggccattcccggcaggaacatgcgagtcaggcgcaccgcggcgagcacgttcacctcgaagtagcgccgccactcgtcatcggtgatctccagcgggtccttggcaccgaagattccgagattgttgacgagaatgtccacctgcggcagcgcgtcctccaccgcggccgcgccctcctccgtggccacgtccgcggtcaccgccaccagatcggcgcccggcgcctccacggccagcgaggcgacggctgactcgacccgctcccgggagcggccgttgacgcccacccgggcgccggcccgggcaagtccgacggcgatcgccgcgccgatgccctgcgtggagccggtcaccagtgcggtgcggcctttcagatcgatgtgcatggcgtcatggtccttccgcctggctgcatgcgcttgctggtcgtccgggtccccggacaggacccgatccatcggccgtcggccgccggagggcgctttcggtgaaggaacggctcttccgggccggcccggcgggtgctggtctcgccgatgatcagggccgcccggtcgtcgtaccgggcggccgacgggggtccgctcgcattcaggacctgagggccgcgccggctgtatcggcgatcgcgcaccaggccgacgggcagccgctcagtgtggcctgcggccaggctctcggcgtggccgacagacggcggggcgacagcgggggcacgggtgcacatagggcttctctgtgtggtgcgtcgcgggcgcgtacgtccggtgcgggggaaccgtcgaccctggggtcgattggcgcatcgcgcggtggcagcggtcagcgctgccggtttccgagcagaacccaacgtatacgcgatcaagacacttggcctgctctggcatccgtgcggggaccgaacagccgcccctcgtgccgatgctcccccacgcccatgggcagctccgatcccgcacgggtgccgactcctggcccccgtccgcgtctggccctcgccctccgcgtcgccacggcacaacgggctcgcccgcccggaccgcgggcagcggtccgggcgggcgaggtggcggtagggcgtacgtcagggcgtgagctgccattgctggaggtagccgacgtcgatcgaggcggtgtcacggacccgcagtttccaggtgccgtcgaccggctgcgcggaggcgtcgaccgtgaaggtctggtcgacgttgtcggcggaaccgccgctgtggttcagcagcgagtagacggtgccgtcggggccgaccaggtcgaccgtgaggtcaccgcggtatgtgtggacgatcttgacgtagacctgggtggtcgccgaggcgttgccggtctggccggtgatgacgatcggggactccaccgcggctccggcgtcggggatgtcgacgcgggtgccgttggcgtagatgtgcgccaccctccagctgaagctcaccgaggcggccgtgccggtgctgtccgtgaccgtcagtgtcacctcactggtgccggcggtggtcggaaccccggagatcagcccggtgtcgctgagcgtcagaccgtccggcaggccggtggccgcgtaggtgagaccggcacccgagttggtggtgtaggcgtcggtctgcagggagacctcctggccgacgccgctggtctggtcggcgatcggggcgatgttgacgccgagcgctatccggtcgccgacgttgatcccggcccacgcggcggcgacggcgaggtaggtgtcgctgtaggcaccgaacaggtcggccgctgcctggagggtcgcgacgcgggcgccggcgtagttggtggtggaggtcatgtaggtggtgagtgcccggtaccagatccgctgggcgttctcgatgccgatgccggtcacggccttgccgtcggacgtggggctgtcgtaggagacgccgttgacggtcttggcgccgctgccctccgagagcagatagaagaagtggttggccgggccggaggagtagtggacgtcgatgctgcccagcgaggaatcccaggagtcgcgggaggacccgtccttggacggcttgtccatgtagcgcaggggggtgccgttgccgcggatgtcgatcttctcgccgaccaggtagtcgggcacgtcggcgggcaggtcggcgtggaactccacggccgcggcgaagatgtccgaggtcgcctcgttgaggccgccggactcacccgagtacgtgaggttggcggtggcgctggtgacgccgtggctcatctcgtgcgcggcgacgtccagagcggtcagcgggtgcgtgttgctcgcgccgtccccgtaggtcatgcagaagcaggtgtcggaccagaaggcgttgacgtacgcgttgccgtagtgcgcgcggctgtaggcggccacgccgtcgttgcgtatgccgttgcggccgaaaacgtccttgtagtagtcccaggtggccgcggcgccgaaggcgacgtccacgccggcggtctgccggttgctctgggtgccgtccccccagacatcgttgtcatctgtgaacagggtgccggtgcccgaggtgccctggttcaggtcgtaggtgcggtgccccgcacggtcggcgtccaccagctcgtacgtggagccggagagcgtgctgccgagcggaacggttccgctgaactggccggtgcccgtaccggtgcgtacgtcctcgaagtcgaagaccgccttgcccgaggtggcgtcggtgatgacatggagctcgctcggcgtgccgtcgtgctggacgccctcgaccaccgactcccaggccaggaccggcttggctccggcggcccagacgaccagccgtggcgcgccgtcgatcttgggatgcttggcatcggccttcttggcggccgcaaccgccttgcccgcggccgtggcggagctgaccttggcggtgacggccggaaccctgacggtggccttggtggcctcggacaccgtcgtgcggccgccgttcctgaggtgcacgaccaggtcgccgccgaggaccggcaggcccgcgtacgtgcgctcgtagcgggtgtgcgtggtgccgtcggcgtccttcgcgacgtccttgacgatcagcttctccttggcgccgaggccgaggctcttcgcggtgtcgccgactgcggcggtcgcgctcttcaggagcgcggcatgcttcgcgggagacagcttcgccggggctgcaccagccctcggagtggctgcgatcttcgcatgaccggggtcgcggggggcggcggacgcgacgccggtctgaaacccggcggcgaacagcgtgccggcggtggtgagggccaacgcggctgtgtatctgcgtcgatgcgaggagcgagggggccgtgacaagggcttctccttctgcgacggtcggcctgtgaagggggccgagagagcggcccgacggggtgcgggcggccgggaatcgcgctgagcgggaaggcgccgcacgaggggacgctcgaggcgtgtccggactcggcggcgcatgagaggtggggggtgaagaatcggtgaacgtgcgaagagcagattgacaccgcacccgcgttcttgtcatggagatgacaaaataacggctcaaattagctattgcttgctggatgttcgtccggactcagggcccttttcggccgcggccggacgacccgcacggcgaggccgggcggctgggccccgccccggacgggattcccggtccggggcgtgagcggacagacagcccgtgacgtctctgtaccgggcccggtccgaggtcagggccggtccgaggtcggggccgggccggggccgggccgggccggggccgggcggcagggggcctgtcgggtcagtgcgggatgtcgtcgatcagctcgcgggcgccctgacgcagcagggcgacggccacggaggtgccgagcgtcgccgggtcgaggcggcccgcccactcgtgggcgttcaggaccgtcttgccgtccagggtgaacacgctggcgcgcagggacagttcaccattgcgttcggttcgggcgtagccggcgatgggcgaattgcagtgcccctggagaacgtgcaggaacatgcgctccgcggtggcctcgcggtgggtgcccgggtcgccgagttcgctgatggtctcgatgaggccggtgtcgccctcccggcactggagggccaggatgcccgcgccgatcggcggcatcatggtctcgggctccaggacttcggtgatcacgtcctcgcggccgatgcgttcgaggccggacaccgcgagcagcagggcgtcggcctcgccggccgcgagcttctccagccgccggttggcgttgccccgaaacggcacgcactccaggtgggggtacgcggcggccagttgggcgacgcggcgcaccgaggaggttccgatccgggtacccggcggaagttcgtcgagggtgagcccgccggggtggacgagggcgtcgcggatgtcgtcccgcttgaggaacgcggcgaacatggtgcccgccgggagcggccggtcggcggggacgtccttgacgcagtgcaccgcgagatccgcctcgcccgcgagcagtgcggcatcgacctccttggtgaacgcgcccttgccgtcgaccttggacagatcccccatccacttgtcaccggtcgtcttcacggccacgacttcggtgcgcgtgcggggatggagcgcggccagttcggcgcggacgcgcgccacctgggccagtgccatgggtgagtcgcgggagacgatacggatcagttcaagggcggacatgccgctcacgatagcccgtcggatccgcgcttcgacgaccattccggaggcccatctcggctgcgcgggaagcatgttgaccacatcggacggatgtgcgagcgcgatcggttgacgggcccgtgccgatcggcacctggaccgtcggggagctcggggacctcttccggaggcagccgcacccttcggacgcggcgcggtgtcccacctgtcgccgggggcgactcccgtcctccgcggcgacgggactctacgaggcggtcggcaggttcaggtcgtggttgacggcgcgggcggcgcgctccacggtggcgatgccgtcgtccatcgtgcggttgccgtgcgagagcacagccatcccgtagtcgtgcccgccgccggtgaacacgcccacgctgtgcacccgccagccgttggtctcacgcggcagccagccgttcttgacgtgcacggtcgtcgtcgagggtgccccggtcggcgcgccccatcgctgcccggggatcactcggttcatcaggcgaagggcataggcgcgggcgtttcgatcgaggaccgagttgtccgaggtgagcagtcggagcagcttcagctggtcggcggctgtgatccgggtccgcccccagtagcccttcgggccgggaacggtgtcccgcattccggccagagtcaggaagtgccggacgccggcggcccctacttgatgccacagggcattggtcgaggcgttgtccgacttggtgatcatggcggtggtcagtttcacctcgcgaggggtcagccggcgatgttcctcagccgcctgacgcagcagcgcccccaggatcgtgaccttgaccacgctcgccgagtcgaaggccgcgtcggcccggtacgcgcaggaggtcttcgtggagcggtcgtacagggcgagcgccgaggcgccatggcgtccacggagggcgtcggcgatgtcctgcgacagccggcccgccagtcctggccgctgcgaggtgcacgtcacctgtgagccgccgacggacgcggcggcggtgctcgcctcggcgggggtggccgacgcgaacgccgtgagcactgccccggcggccacggccgtcgccagtccccgcgtcgcgcggcgcgatgagtgcgttccaggcatggaggttccgtcctgctgtgtgtctgcggtcacatcgacctgtgtgtctgcggtcacatcggcggcccactcgccctcgacggtgaggcgacaccctcggggcgtccgcgaacgccggtcgccggctcacctatggagcgaccggcgggccatcccgaaatgttccggttcgccaatgacggcgacgctacagggacggaggaaacaacagtgcgcgagagatgcgcatatgtccgtattgggcgttttccaatggtgtgacattcatcaaggcattcgattgcgtccgtccggggtggcgacgggccgcggcgcgtgccggtagtggtcgaactgtgtgatgccgttgtacgccccggcgatgaaccgcgccttctcgtcggcgttgttggtgcccgccgtgatactcacctccacatgggcaccggtggcctcccgcaccgggtgtccggcaacgtagtagtggtcggccgggaccgggttcaccaggaccgtggagcggacggtggacttcccgagcgcggagacgtccaggtccgtcactgaggtggccatgccgtcgcctcgctggagcgcactctcgccgccccgctcgtcgtccgctcgactcccgtacgcaccacggcccttggcgaggtgatcctcccccacgccggctcggccctcgcggcgacggacgcgatctgcgacgccgccacccggcacgacgcgaccaccggcggcacggtgcgcctcgccgccgaccccacggtccgccagggcctgctgccctcactgccgcgtcactggtccgagcatctgccggccatccgcgtccgggtcttcgaaggcagcggcgaggagacggagacctggctcgcgagcgcggccgcggacgccgccgtcgtggtcgacccgccggccggaagcggcgcgcaggagtacaccccggcccatcgcgtacgggacctcgggacgctcatcagcatggcccaggccggtctcggcgtctcgatcctgccggaggtgtcacggccgttgatcccccgggacctcgtcctggtgcgtgtcgcaccgcaccacagcaggagactcgccccgtgcggaccgcggaaacgtccatggcccccgcagtgcgtgctctcgtggactccgtggcccggtttccgacgggcgcgaccagcctcgtgtgccgacctcatggcaccgaccggaactcccctcccgtagcggccggttgagcaaacgggcagcgcggccatcccctcggagcatggccggccatggcgcccggcggacacacccaggtaccgggtgagcacacctcttcgcggaaaaccccgtgcgacgtgtcgcacagggcggcaactcctcgtatgcggtggcgcagtgcgccgacaaagacgacgcaccccccttccgcctcccccggcgcaaccccgacgcacgtgggacagccggggctccggcaagagcctcgacctcgccccgggccacggcggcgacgaacagcgctggaaggcggggccggggcccgcctgaagttcctgtccggccgggccggtctcactccgccgggtcttcgccgaggccgaacaggaacactccgccgcgatgcgccgatggttgcgccgaggccgacgcgaggccgtgacgggtcaggggttgtcctgctcgttccggccgaactggtccttgagcctttcctggccggtgtccacctggccgctgtacttgctctgggtcctctcgtcgacgtagtcgccgcccttgtcgacgcccttgttggtctgctcctcgtggcccttgagcaaatgcttgagcttgtccatgacagacatgaccgtcctccttgccgttgactccccgtctccagggtccccactgcacgcgggaagcgcatcttgaggagcgcggcagcggcctgcgtgaggcacgtcggcgggagcgggggccgtcaagtcggtcaggccgtggcctgttccggcttgccggaggcgcgcaggaccggatccgtgcgcaggcgcaggaagacgatccccagggcgacggcttgcagcgcggcgcacacggcgatcacgtggccgagtgcccagggcggtgtgacggcgaccaggatccccgcgaccgggaagggcagcagcagaagcaggatggtcagggagagggtgctgccgaagacggccgccgggatgagaagcgaccggagtgtgcgcaggacgacggtcaggccaccgtcaccggccatgaagagtgccatgagtacgacgtaggcgaggtacgtgggagcctgggccagggcgagacaggccgcggacgcgatggtggagcagacggcaccgactccccacagccccagccggccgagtgcgaaccggcagacggctaccgcgaggagcgtggatgccgcggcggccgaccagagggtgccgacggccgcgggagacagaccgaagcgctcgaccacgatgatcggactggcggactggagcagcccgagcgcgagattggagatgctcagtccggccaccagacagcccagtgcgggcagcgagcgcaaggtgcgccagcccgccttgagacctgcttccggccgcttgttgtggcgccccgagccgcgaagtggggtcggcggggtctgcagggcgagagctgccgccagacaggacagcacgcccaggaccacgagcatgcgggtcggccccgccagcagcagtacgcctcccagcgcggggccggtgagcgtcgccgtctggtcgatgccgatcagaacggcctgcaccttgtgcgcctgggtgtccgtacggcggctgacgatcgcgcccaccgcttcattggcgatgaagctgaactgtgtcagggttccggttccggcagccagcgccatcacgacgaccgtctccgccgtcccccgctggagcatgatcagcgcaacggcccccgccgccaccacgatcgcccgggccagggaggcgaggaagaacacgaccgcggccccgcgccggtcgaccaggtcaccggccaggccgaaggccgccactcgcgggatccactccagcgcgaaggccagcccggtcagccgggcggagtcggtcgtggccagcaccaggagcggcatggcgtacgtggacatggagaaggcgagcgcgtcgaaggcacgcggcgcgtagacccggcggaggaggctgccgtgggggacggccgcatgccgaccggccggtcggtcctcgtagagttggatggtcacggagtggtgaggggctttcactcagcggcgatgtgggggacgcctggaaggtgggggattcctgacgcggtgcacgccagtgtgcgactcggttcgtctgagcggggtggtgagcgtacgagcggtagtacacggacggcctgccggggggaggcaggcggatgaggaggcggctcacgtccggcggcgggtgcccggcggaacgggttcagcctgccgaggctcgcggattcgtgcacgccgtggcgcgatgtcgggtcacgcgaactccgctcggaatagggcgagttggaaaacgggcataccaaatgacgcggcatgcccggaaccggggaaaggggcactgacgaatgcctcgtttagacatcaaccacagtgcagccacagggtagccgaagccttcggatcatccgcaaggggtagtccgccaacgtcataggcctgtgaccgaatgcgctgccgaccgccgacgcgggatgacccgaagccaccgaaatgccatgtgttcgcgcacgagttgccaggagtgacgccctggcttcccggaaccggtctattccgcgtagaacgtggcgtcctgccggtcgagggcggtgctgaccggctggatgcgcagcaggttctcgtagtgccgcaggtagcggccgggatagttgtacgactcgaaagcgatgccgtccgcggagtcggccaggcccgcccgccgagagaaggacgcgtcattcttgaaggctgatgagccgtcgttcttttccacccatacctcgtagttcttgtggcggaggtagtagcccgggtagttggccgattcgagggagatcgtgccgctgccggccagacctgtgaccacccggaactgcgagtcggcgaggttggtgacgttcgcctcgatgcgcgcccggaagtcccagtggcggatgtagcggtccgggtagttgtacgaggagaagcggaccggggtgacgccatcggccacgggaataccgaagttgggggtgccgtcggcgttccagtagaccttctggaggcgggtgcggcggttggggtcgttgagcgggtcgccgctgatgtccttgtagttgcggtcgtggtagacgaggatgtcggactttccgtcctcggagacagtgaaggagttgtggcctgggccgtactggccggtcgcctcactggtcttgaacacgggctgggaactcttcgtccaggaggcggcgttgagcagatcggcggaggcggacgcgctcagcatgcccaggcagtagttggcgtcggtggcgctcgccgaataggtcaggaagaccttgccgccgtgctggatgacggccggaccctcgttgaccttgtagccgacggtctcccaggacagcgtgggctgggagatctcggtcggcgtgccgctgatggtccaggggttggccatcttggcgatgaagaggctggtgttgttgtcctcggcgggattgcgctgcgcccaggcgagatgacggacgccgttcacgacgaaggtggtggcgtcgagcgagaaggaggacaccggcgtggcgatctggcccttctcggtccagctgccggtcagcgggttcgcggcgccgctctccaggacgtacatccggatcgcccacacgtcgctggtcgacccggcggcgaagtacacgtaccacttgccgtcgatgaagtggatctccggcgcccagatgtgggcgcccatcacaccgctggcgtgcttggtccagatggtggtctcgggggcggtggccagaccctggagcgtggtggcccggcgcagcacgatgcggtcgtactccggcacggtggcggtgaagtagtagtagccgtcggtgtgcttgaagatgtgcggatcggcacgcttctcggcgagcgggttggtgaaggtcacggagggcgaggccggggcggtcgcgtgggcgggcgtacccatggtgagcagggccagtgcggcgaggaccgcggtgaacaggcggacggtgagacgtctcatattcctggggctccggtgtcagacggtgggcttgagctgccactgctggcaggcgttgtcgagccaggtccactggcgtacgtcggtgccgtcgccggtgccgcagtcggccacgtcggcgaccttgccgctgttcgcgttcgtgatccgcacgtagtcgcttccggtgtggacgagccggaatctctggcagttgttgttgagccaggaccactgtctgaggtccgcaccgtcggcggtggagcagtcggcggtgtccatgaccttgccggtggcgacattgaccagccggctggtgtcggtgccctggtcctcgatccgccacttctggttggcgccgccgccgcacgtccactggaagatgtcggtgccgtcggcggtgttgccgccttcgacgtccaggcacttgccgctgttgcggttgacgatcgtgtacgccgtcggggttgccgcggtctccccggaggggcccgcgagggtggtgccggtcgcgaccggggtgccgaagttcggtgtgccgtcggcgttccaggtgaacttctgcgcccgtgtcgtacggccgtttccacagccgccgctcgcggagctgttcgcgtggtagacgatccagttctcggtgccgtcgggtgaggtgaagaacccgttgtgcccggggccgtagaccccggccgcgtcatcgcgctggaagaccgggttctgcttcttggtccaggacgctggggagagcgggtcgccgccggtcagttcgagctgaccgagtttgtagtccgcggtctggcagtagctggcggagaacgtcaggaacgtcctgccgtcgtgatacagcggctcggggccctcgttgaccggggcgccggacgtctcccagctcagcgtggggctggagatgacggtgaaggaggaactgctcagcgtgtacgggttgctcatcggcgcgatgaccaggctctgcgtactgccgttgatggagccgctgcccaccaggtacagcttgctgttgtactggagcacgctggcgtcgatcagccagccgccggggttgaggttggagccggtgaggctgttcttgtacgtgtacgggcccatcgggtcggcgcccgcgctctccaggacatgggtgcgctgggtgtcgcagcaggcggctccgctctgcgcccccgagtagtacaggtaccacttgccgttgaagaagtggatctccggagcccagaagttcgcgttgcggccggaggtggtgtccgaccagatctggacgctgggagccgtggccagcccggccagcgtcggcgacttgcgcatggtcagctcgttggtgaacgaggtcgtcaccaggtagtagttgccgttgtagtactccagccaggggtcggcgcccttctgcgccttgacggggttggtgtacggccgtcccccggccgcggcgacggactgggccgggacgagcgaggcgagcagggccagcagcgctgccccgaggacgaaccagtggcgggtgcggaacacgtgggtaccctccggagacagtaagttcgaaataccgaacactgtgcgcaacctcgaccagaaggtaggggtgggacaggaggagcgtcaatggatgtgccgcgtttggtttccgtcggttcctcggtaccgtcagcggccgtcgagccgggcgagtcggcggtcgtgtgcgcggctgagcagcagcagtgagcagacggctccgatcagcgcgcagaacatgtcccactgggtgtcccacacatcgccctgggtggccaggaacgcgtcggcggcatgccctcccgcaacggccgcggcccactccaggagttcgaagaccgcgctgaaggcgaggcaggcgcacacggtcaggggcgcaagccaccggctgccgcgcagcggcgacgtgcgggtgaggatctcccgtaccaggacggcgggcacgaagccctgcatgaggtggccgaaacggtcgtaggggttgcgggagaggtccagccagtcgcgcacccagtcaccggccggcacctcggcataggtgtagtggccgcccaccgcgaggaccagggcgtgcgcggcgagcagacagtacagcaggctggtgagcgggaaccgcctgcgcagcagcacgaccagcggcagacccacccacgcccacacggtctccagcagccaggtagtggggtctttcgcatgccaggccgacatggcgagagcgacggtgacgacagcgagcagggccacgggaagccgccggcggacgacccggtcgacggcgagccggtcagcggggcgggagcttgcggcggtggtgacggcaggcatgacgggctccttgaggtgggtggccaccatcgtgaggggagcccgtgccgccgacatgagtacgcgtacttatccgccccgcccccaaccccgccctcatggcatggagctgctcaccggaggcgccgttcccggacggacgtgagcgactcacgcgcccagtgcgcgggcgagttccgtcgtggcctgggtgatctcggcgtcgtcctcggcgagcagttgctcgacgacgctgcgccgggcacgcacggcctgccgcgcctgacgctcccagaccacgggattttcgcggtggttgagcaacttcggatagagggcggccgtgctctcccactgccgggcgtcggctatgttcctgagcaactggatgatctgcgcccggcagctgacctggggaagctgtgcgagctcccagaggaagggcaccgtggcggccgtggcctgctccaccacgaagccgtactggcagattcgttcccgcaagtcgctgagagcggccctggcggtcgcggcgtcaccccacgcgacactgctgagcagcagcgggatggccgccgcagagccgctggagtccttgatgtcctgccatggcacccgccccagggccttgaggggcgtcgctttctccacccccgcggacggcgtacggcctgtgcgctccgcgctcagctgttccgtcgaaccggtgcgcatgatgtgagccctttccgcggcagacatgtcagctggaggggaatgtcgacaacctgacccggacggtcctgcccgcgggggaacaccggggccggccccgctcctcggccggagcggcggtgctccgcgggccccggccgcactccgccacgctccacagcgcggcggagccgggcgcgccgcccgacggggcaggctcgcagaacgccccgttgcgcggagcggcctggcgttgcgctggcggcgcgtatgcaccgtcctgtgcggtccgacctgcccgtggcgcggccctgctggtcaggcggggtgctgggtgcgcaggtgatgacacgacatctccctgatgcgacgtcaaagtgcggcatcagcgctggggttgacgccacagctattatccacgctgacggccccttcgtgcaattgcacgggaaattgcacgaaagttgggtagccgcagcaggggccgtggaccgcggcccgatcacgggtgcgcggagcccgcgtactggaactgagcaaggagagtgccgtgccaacagcgccgaacggagtacaggccagctcattggccgcccggtggatcaagagtcggcacagcaacgccgagggcaactgcgtcgaggtggccgccctcgacggcggcggcatcgcgatgcgcaactcccgcgatcccgaggggcccgccctcgtctacacatcggccgaagtggccgccttcctggccggcgcgaaggacggggagttcgaccatctgctgtgaggacctccgccccgaggccgtccacggcgagtccgtccgccgcacggccgtccagcggtgaagcggacgccaactcccctacttccactgaggcgttcggcggaaggcagcgagatgcgatactgtaattctgaattctgccggtcagcggggagccaggatgtccgccgagtcacatcgcgtctcccgcctcgaaccgtatctggaccgggccgagccggcccccacactcttgaagatgctggtcggtgtccagctggcgggctgccgtgacgacgccggcctctcccaggagcaggcggcacgagccctggggttcagtccggcgaagctgtctcggatcgaagcgggcaagggccgccgaccacccaccgagggcgatgtccgcgcgctgctgcaactctacgggaccgacgcctacgaggcttcggtactactgaaactgctacagcgcgccggggagccgggatggtggcagcgctacgacaagcggttgatgcccgagtggttcgaccggctggtcgggctccaggaagcagccgccaccatccgtaccttcgagatccagtacgttcccggcctcctgcagactccggcctacacccgtgccgtggtgcagcgcggtctgccgacggcgtcggccgtcgaggtacagcgccgggtcgaactccgcacgcgccgccaggagatgctgctgcgcgcggacgccccgcgactgtgggcgatcgtcgatgaatcggtactgctgcgtgtcctgggcagccgtgacgtgatgcgcgagcagctcgagcacctcatcgggatggcgcggcgtcccgaggtgaccgtacagatcgtgccgctggacgtgaccaacgcgtcggcgccggccatccccgtcacgtatctccgcttcgacgggctcgatctgcccgacatcgtctacctggagcacataaagagcgccaacttcctggaggaccgggacgagacggaggagtaccggctgaccctcgaccggctggccgacgaggctctcgacccgcacgagtccctgaacctgatgcgcgccacgctggaacagcgctacgccgatacgtgacggaaccccgccggcgccgcgacacaggagtcccgacgccggtggccgcccggtgcccgagccgggccgccgaacgcggcgctaccgaatgcggccgactccgccgaactcgatccactcctgcgtgagctgacgaggcgccacctcggagtccggtcgccaggtggacacgtccaccagccccggctccaggatgtccatcccctggaacaggtcgacgacgtccttctcctgacgcacacggccccagctcccctgcgtcgtacggtccatgaaatcggtgacgaagtcacggatctgggcgtcttcgctgaccagctgacacatcaccatgaagctgccgggcaccaggcgttcggccacgcgccgggccagcgcgggcggaccgtcggtgtcaccgtccggcaggcagtgcatgaccgacacgaagagcgcggcaaccggctccgagaagtcgatcagacgcttcgtgtcgggatgcgagaagatcccctccgtgtcccgcatgtcggcctggatgaccaccgtgcgctcgtcctgttcgagcagcgcccggccgtgcaccagaaccatcgggtcgttgtcgacgtacaccacgtgcgcggtgggatcgacgcgctgcgcgacctggtggacgttgtcctgggtgggcagcccggatccgtggtcgaggaactgcctgattccgtactcggccgccagcgtcccgacgacccgccgcaggaaccgccggttgttcaccgccagcgggcgcgtgctggggacgaccttgtcgagttcctcgcaagctgcccggtcggccgcgtagttgtccttgccgcccaggtagtggtcgtacatgcgcgcggcggtcggtaccgtggcatcgatcgacgtggacagttgcttaccgctctgcatcgttcccccagctccgtgccgcgccaactcgactggcccaacaggggctacatcctagggagttcacgctcgccgaggccagccccagaacgaaggacctgatgagcggggcccgtccggtcaggcggcgtccagttccgcgagctcctcgacggtgagtacgaggtccggggcggctgccgagtcgcggatggtgtcggggcggctggcccccgggatcggcacgacgaccggcgacttggcgagcatccaggccaggcacacccgctgcgggctgaccccgtggacctcggcgatccgcgcgaacggagcgtatgcggagcccagttcacgggcccgggagctgccgccgaagggactccagggcaggaacgcgacgccgagcgcgtcgcacagccgcagctccggttcgctggagcggaaggccggggagaactggttctgtacggagaccagtctgccgccgaggatctcgtgggcctgccggatctggtccgggtcggcattggagatcccggccatgcggatcttcccctcgtccagcagatcccgcagcgcgccgacggactccgcgtaggggacctccgggtcgggacggtggaactggtagagcccgatggcctcgacgccgaggcggcggagcgaggcctcgcaggcctccttgatgtgccggggagtgccgtccagcgtccaactgccgtcgccaggacgcagatgaccgcccttcgtggcgaccaggacgtccggaccacggtcgtgggagccgagggccttggcgatcagggcttcgttgtgaccgacgtcgtcggcgtcccggtgataggcgtccgcggtgtcgatcagtgtcacgccggcgtcgagcgcggcatggatggtggcgagcgaacgtgtctcgtccggccgcccctcgatcgacatgggcatcccgcccaggccgacagcgctgacctcgacatcaccgatacggcgagtgtgcatgagttcgtgacctctcttcagcgctcgcgcgaaacggggcacccggcccagccggaagcgtgccgcggccgtgccggacgctcaccagcctggctggcccgcgagcgcaggtccaatagaagaaaacgaacgcattgagcagtcggggaactgaatggattgatcacggcgggccgacgcgacggcaaacggggcatccgggccgggaccggacggcgggccccggaccggaccgcgccccgcatcacgtcacctcgcggaatggttgcgccgtgggtgggaccgcgtgcaacgatcaccgcacacgtgccccgcaccgcagacggaaccggcccgcagggcaccgccaccgaggaaaggccgcgacatgcgtatgggactgctcgggacaggaccgtgggcacaggcagtccacgcccccgcgctgagggggcacgacgacctggagttcgtcggggtctggggtcgtcgcccggaggcggccgcatcgctggccgaccggcacggcacccgtgcgtacgacgacgtcgacgccctgctcgccgatgtcgacgcggtggccgtcgccctgcctccggcggtccaggccgagctggcggtgcgcgcggcgcgggcgggctgccatctgctgctcgacaagccgatcgccacgaccgtccccgacggccgggccgtcgtcgaggcggccgagcgggccggcgttgcctccgtcgtcttcttcaccacccgcttccagtccgagacggaggcctggatcagcgaacagggagccgcgaaggggtggttcaccgcacgggcgcagtggctcggtgcggtgttcaccagtgacagcccgttcgccgcgtcgccctggcgacgcgagaagggagccctgtgggacgtcggcccgcacgccctgtccgtgctgctgccggtgctcggcgacgtcaggcgcgtggcggccgccgcacgcggaccgcgggacaccgcgcatctgatcctcgaacacgccggcggggcgaccagcacgctgaccctgagtctcaccgccccgcccgccgccgcaggggccttggtcgagttgcgcggtgagaccggcgtgacggtcctgcccaacagctccacgagcgctctcgacgccttcgcccgagccatcgacgccctccgcaccgcggctcgcaccggccgtccgcacccctgtgacgcgtcgttcggtctgcgcgtgagcgaggtactcgccgaggccgaagcgcgtttggccggggactcccccgcgcagtgacggcatgagcgccgtcccgagaggtcgacgcgcggacctcgcgacgcccgcccggccggtcagggcttcacggccaccactccgaactgcggcagcacgtcggcggtggagtcggagcgccaccgcgagcacgagacgatgcccggggggatcaggtccagtccgtcgaagaacgcggcgacctcctcccggctgcgggcggtgatgggcggggtggcgttgtcgttccagaacttcatggccgcgacgttgccctcgccgccgaggccggcgtccgtggtggggtgggtcaggacgagatggctgccggagggaaccgcggccatgatccggcgcacgatgtcccgcgcccgagcggtgtcgaggacgaagttgagaatccccagcatcatgacggccacgggccggccgaagtcgagggtcgccgcggccccccggatgatcgtttccgggtcgtgggcgtcggcgtcgatgtagtcggtggctccctcgggggtgctccgcagcagggcgcgggcatggacgagcaccgtggggtcgttgtcgacgtacacgatgcgtgcgtcgggggcgatccgctgggctatctcatgggtgttgtccagggtcggcagtccggtgccgatgtccatgaactgccgcatcccgcactcggcggtcaggtgccgcaccacacgccccaggaaggcgcggtccgcgcgggcgacatcgcggatcaccgggaacatggcggcgacctgctcaccgacctcctggtcgacctgatagttgtccttgccgccgatccagtagttccacacccgcgcgttgtgggccacaccggtgttcagcacggccgatccgcccgacgggctgtcctgctcgctcacgtctcttccccttctgcgcgacagcagcgtgtccttggcgcacgcggcgcacggatcccggaaggagccaccctacgaagcccgatcccgtcccgtccgccctcgcgctcacgaacgatacgggcttgccgtcggcacgccgggtccggtccgggtccgtaggacgggtgtaggagcgccggtgaatccgtgcggagcctgcgccaaccgttgacatgaacgcacccgggcgtaactctgagagcgctctcaatttggtacggaccaaactccactcccccacgaactcgtacggaggcaaagcgtgttcgagagattcagacgccgggcgctggccccgctcgtcacgaccgcgctggcagctgcgctgctcacgatcggcggtccgccgtcggccgaggccgcggtccccgccacgatcccgctgaaagtgaccaacagctccggccgcggcgaaccggtgtacatctacaacctcggaaccctgctgacgaccggtcagcagggctgggccgacgcgaacggcgcgttccacgcctggcccgcgggcggcaacccgcccacccccgcacccgacgcctccatccccggaccggcggcgggacagacgaagacgatccggatccccaagttctcgggacggatctacttctcctacggacagaagctcgtgttcaagctgaccaccggcggcctggtgcagcccgccgtgcagaacccgagcgatcccaaccgcgacatcctcttcaactggtccgagtacacgctcaatgactccggcctgtggatcaacagcacccaggtcgacatgttctccgcgccctacgcggtgggcgtgcagcggtccgacggcagcaccgtcaacaccggccacctcaagtcgggaggctacaacgggttcttcaccgctctgcgcggccagccgggcggctgggccaacctgatccagacccgctccgacggcaccgtcctgcgggcgctgtccccgggccacggactggagaccggggcgctgcccgcttccgtcatggacgactacgtcaaccgcgtctggcagaagtacagttcgtcgacgctgacggtcaccccgttcacggaccagccgaacaccaagtactacggccgggtgtcgggcggcgtcatgaacttcaccaacagtgcgggagccgtcgtcaccagcttccagaagccggacgcggacagcatcttcggctgccacaaactgctcgacgccccgaacgacctggtgcgggggccgatctcgcgcacgctgtgcgcgggcttcaaccgctccactctcatcacgaaccccaaccagcccgacaccacgacggccggcttctaccaggacgtcgtgaccaaccactacgcgcggaagatccacgcccagatggccgacggcaaggcgtacgcgttcgccttcgacgacgtgggcaaccaggagtccctcgtgcacgacggcaacccgctccaggcctacctcacgctcgacccgttcagctgagcccggtgcccggacggaccggcacaccgggtgagggggtacgggcagctgtcgcacgcccgtgccccctcacccttcggcgcgagtgcggaccagcaggagcgccacgtcgtcgtcgggctcgggccgcagcgcgctcagcagcatgtcgctggtcgcctccagcgagttccgggcgccctggagaaggcgcgtcatggtccccatgccggtgtcgatggactccgtgcggttctccaccagcccgtccgtgtagagggcgagcagggtgcccggcgccagctcgtgccgcacggtgccgaagtccacgcccccgacgccgagcggtacgccgccggggacgtcgaggagttccgccccgccgtcgggccggaccatgacgggtggcaggtggccggcgctggagagctcgcaggtgccctgccggaggtcgcacaccgcgtagacgcaggtcgcgatcgcatcgccgagggagcccgcgatgtcgtcgaggtggcgcagcagctcggccgggggcaggtcgagccgggccagggcgcgcgtggcgctgctcaactggcccatgatcgccgcggcctggacgcccttgcccatcacgtcccccacgaccaggcccgtccgtccgcggcccagcggcagcacgtcgtaccagtccccgccgacctcgctcagcgccgggaggtagcgggccgcgatgtcgaggccctcctgctgcgcgggcgcgggcggcagcagactgcgctggagcgtgagggccgcgcttcgttcgcgtccgtagaggcgggcgttgtccacgcagatcgccgcgcgcgccgcgaattccgaggcgaggacgcggtcctgttcgtcgaaggggcgcgcgttgatggtgcggtacaggctgagggtgccgagcacttcaccgcgggccaccagcggaacggcgaggtaggagtggaccccggcgacgcgcagcgcctgggcggcgtgggagtccctggcgatgcgccgcatcatccccgggtcgacatgttccaccaggatgggcctggcttcacggacgcactgggtgatgatgcgggacgagctgtaggaggccagctcccccaccgggtccgccgcgtggatcgcgtcggtgaggtaaccggccgcgacggccagcgccctgaactccgcgtgcgcttcccccgtgacggcggcggtgactccgtgggcgaccaccgcttcgagcacgtctacggcggccaggtcggccagctgcggtaccgccacatcggcgagttcccgagcggtctgcgacagatccagtgtggtgccgatgcgtacgcccgcgtccgcgatcacggcgaggtgctcgcgcgcctgggcggcttcggctgccgcctgctgtcgctcggtgatgtccagaacggccatcgccagaccgagcacgcggccgtcggagtcctcgatgcggtggtacgactccgagtaggcccggtcctgcgtgtcggctggcgtacggccgacggtctgctggtcgagcagggatttgccgctgaccaggacgtgccgcatgcgggactcgatgacctcgacgtccagattcggcagcacttctccgacacggcgtcccagtaccgcctcctccggcagaccgttgatccgctccagggccggattgacgcccacccagcgcagctcggtgtcgaagaccgcgatgcccaccggcgtctggttcaccaggctgtgcgacagggcgagatcccgttccacgccccggacggtcgtcgcgttcgccgccagccccagcaggtgcatctgtccgtggatgtcgtgcagccgcatggtgcggaactccacccggcgttccgtgccgtcgctgtgcaggagcgggaagactccggcccagctggatcccgagcgcacctgcgcgaacagctcccgggcccgctgctggctgtccggtgacaccaggaggtcgtcggcgtagcgccccagcgcctcttccgcggcgtacccgagcagctgctgagcctcggggctccacagcacgatgcggccgtcgccgttcagaaccacggcggcgacctgcaacaggtccagcagtcctccgggggccgcggtgatctcgtcaccgcttccggtcgagtacccgtgcattccagccgctccttccggcgcggcaccggcattgccaagatccgctctacgggttctccgattacgtcacaacaccggcggcggagcaacacctgccccgcccgcgcgccgccaacccccggcggggggtgtacgcgtgtctgcccgtcggtcggcgaacgggtgaacggcgcggcgatccgcgacccgtgcggcgcctcgcgaccgcagcacgacggcggcgggcgcgcacgggccgggtcacagcgatccgcccatggacggcggtgtcagcccggagttccgtccgacggggtgatcttggtggcgacgtcccgcagtttgatgttcaggtcctgcgatgtcttcttcagcagctcgaaggcctcgtcctggcccaggtggaagcgttccatgacgatcccgatcgcctggccgatctcgtcgcgcgagcgcagggcggtctgtagttgctcctccgtgcgggcgtaggcgaaggcgacggcggcatgagaggcaagcagccagcccaggtgctcgtcacgctcggagaaggcgttcggccggaacgagtacaggttcagggcgcccagcgtgtggtggcgggtgaacagccggaatcccatggcactgcggatgcccagctccgcggcctgcggcgcgtagcggggccagcggtccccggcggtgcgcaggtcggggatgcgctgaacgggttcctcgtcggtgacggcgttgaaacacgggccctcgcccagctcgccctggatcgcgtcggacctgcgtacgacgtcgtcggtggcggtgagtgtctgcacgttcttgcggctcagggtgagaatgccggagacgtcgcatccctcgatcagaccgaccgcgtggaaggcgatgcggtcgacggtggcctggagggactcctgcgcgagcagatcccgcgccatgacggccagccggtcggcgagctccggccaggcttcgtcggacgtgccgtccgctgaggacgggccggaaggcggtggaccactcatggggatgaccttcccactgccgtacaggctttcggatgcgggccgcaccgccacattacatcgcacggacgcggtttcaggggcaccgcccggctgggccccccggccccgcgcgggctcgcggtccggggcggttcctgcccgcaaagactcagggcgcctcgaccgaggggggctgcccccagggctcgctcagggcccgccgcagggcggtggccgcgtcggcgccgatccggtcggccaggacctgctcgatgagcgcgagcgcggtctgggcgcgctggtggactcgggtcccttccgcggtggtgcggaccaggctgctgcgggcggaggcgggatccgacacctgttccagcagccccatgccgatcagcccgtgcacggcctggtgggcggtctggcgggtgatgccgatccggcgggcgagctcggagatggaggtcccctcgtcgtccagtacggcgaagacggcgccctgggcgatgctgaccggctgctcgcccgccgcccgcatgctggccagcagcgcgtcgtcgaaccagcgtttcgcctcgaggaacagctgaggcaggttcttggcgggtccggtcatggctcctccgacgacgggcggacttcgaccgggtacgggcgggacggggacaccacgggccgttgacgccccgccggaggcgacgacgcctcagcgcatgcgccgggaccgccccagcacatgcgctgaggcagagcgtcagccccggtcagccgagcggctccgctactccgcggacaccttcacgtcctcggagacgacgtcgctcgcgtaggcgatggagaggccgggaatctcctgggccacacgcgcgaccaccgcgcggtgccaggcggccggataaccggattccgggtgggcggcatggtattcggcgtcgtcccggtaggtgacgatcccgggctcggggaggtccaccaggctgttcaccacctcggcgacgaactccccggtgagtcgcccgaggtctccgagggcccctcggacggccgcgggaatccgctcctcgccctgctcccaccgctccacggtgttcggtgaaacccccacgtgctcggccagccagccgccggtcaggcccaggaactcccgcacgacccggaactctgcgggtgtcatgccccgaccctcgggcacaccgtcaacgttgcggttctgggtcatggcgtcctttcggaggggaagggcaccggcgtacggccgtacggcacgggccccctgcggtcacgagcgggaacgcccgcggtcggaccgttcaccgtacccggcgccgggcgggccatgccgggccggcgcctgcggtcaagatcccaggccgaaccccttcgtcgtgtaggcgcactccgtgtagaggtaaccggaccgaagcttggccgtgtcggacgcgggagtcgcgctggagtcgcccatcggcttgtgcaggaagtacgtggtgccgaccggcagagtgatcgtccgctgcgggtagtgcttgccgctgtcgttgcaggggttgaagcccagcaggagggtgctggcggtcgagtacgccgtgcagccgccgcagcccttgagggtgaagcttccggtcacggggcccgtgtacaggaccgtgatgtcgtcgggactgtcgttcttgacggtcaccgagatgcttccgccggacgccgtcgtgggcaggcgcttgcccgctgcgggcaccttgagcgcgacctccgcggcgatggcgatctttcgggcacgtgcccggttcttgtcgtgtttattgctgtcggcgaactcgctcagcgtcgtgcgcgccgcgtcgaattccccgtccttgtactggtccacaccgcaggcgtacgcccccgcgtccgcgctcttgccggcccggccggcgtcccgcgcgagggcatcggccacgccggccttgtcccccggcaggcgggccacctgggagctgagaccctgcagccgctcgacggccgcgcacggctcgctgccgcgcaggttcccggcctccttgtcgacggccgcgcggacctccggctcgatcttcttggcctgcggcgagtcggggaaggtggtcaggagagtgctgaagtgcccttcccaggtcacgtcggccccggcgaggccgtccgtcccgcactcgtagagggaggcggccagacggtcgtcgggccaggccgccaaggagccgagatccttcttgtccagggtccgcggaaccgtgcgcagatacgtgagcggcgctatcgcggcgcagtagtccttccgcgcataggcggcaccgaccgtctcgtagaacgacgtgagccggcccggcaccttgcgggccgcgcgggagtccgggtggtcggctctgagcccgccgtagacgcgcagcgcttcgcggtagtcggactgggcggtgccgaacgacttctgtccaccgctccggacgaggccgtcggcgcgctcgagccggtcgaggagcatctgctgggtggcctcctcccgcgccgaccgatagaggacggagccgccgaccggtacggcgaggagggccaggccgagaaggacggcaacaggagaccgcgggggccagaccaaccgggtacgcaggccgacgaacgcgccgtgcaccgcggccagcaggagaacgacgacgtacacggtgagcaggccgcctccgacaccgtccgggtcggcaggcagcgccagcaacagcaggaccccggtcgcgatccagcacgcggccatcgggacccagcggcggatgagcgcgtaaccgatgccgaggccactgaggttgagcagcgccacggcggcggcacgcgggcggtccggcggggcgggcggcggggcggacggcatgggtggtgcgacgaaaccgttcgtggcggcatgctggtctccggacatggcggctccccccggtcaacaacgcgctcatgtctgcaagttgtaagtgtacggccaagcgttcgactcagatagcgggcggacgccccggaccgggcagagggccccggaatatgcgaatccactcctccagggcctatggcgccagcgcggcacagccgtcgaaagcgcgcgattcctcgcgaggccgtggatcaccgcaccgttgaagttgacgatcttgggcagatggcagcagtgatcatcgtgccgattccatgaggggggatcaccacccatggccacacctgtgcgccgaatgccaccgatgcgccgcaggcgcgccttcgacctccggtcgacggccctgttcttcggcctgctcgccgttgtcctgagcgtcgcgggtttcgccgtccgagccgcggcccgtgtggtcgaacagcgcccgggactggtcatgatcctgtgcctcatcggggtaccggcagcggtcgtctgccgacaaggccgccggcggttctccgcggccagggcggcacgccgggtcgccgccgcactcgacgacgcaacgcatacggcgctggacgcgctggaaacggcacagcccgtcgctcccgctcccgctccggtcccggaccgactcgcgacgcccgtgcccacctcgcgggacaccaccgtggtcattctgcccggcgaggccgaagggaccgtcgagctcgaaacgatcgaccacgaagcgatcgaccacgaagagttcgatgacgacgcgttcgattacgacgccctggacgccgacgagttcgagcaggccgtagcggcgctgtgtgagcgggacggctgctccgacgtcgaagtcgtcggcggggccggagacctcggcgccgacgtggtggccacggccccggacgggcgacgcgtcgtcatccagtgcaagcgctactgcgacaccaacaaggtcggctctcaggaccttcagcgattcggcggcacctgcttcaccgtgcaccaggcccaggtggccgtcgtgatcaccaccagcgacttcaccactccggccaccgagtacgccgaccagtgcgggatcctctgcttcgaccggcaggccctgctggcatggagcgacggcacgggcccgcagccgtggggagaggaggtcgccgtcggcgacccctgggccggcgacgggcccctggagggcccttgcgcgcggcagggctgaatccggcacgggcggaaagaaggtagggcggggttcgtatccggcatacggggactgttcctcgtgggcgaccgcgagctgctgtcacccgcacgccccgctgttgcacgcacggcctgcggttgcaggcatgaccttgaggaggcaccggcgccatgggaaccgccgtgcacgtcccgcagacccgggacatgatcggggaggagctctccggcgacgaggcgctgaccgcgttgcgtcgctacggcggcctgcgactgctcgtcgactcgttcgcccggttccgttacgccgacggcttctcccatgcgcgcgccctcgggttccaagtggtgctgggcatggtgccgttcacgatcgcgctggtcggcgtcgccaccacggtgcacacggagagcgtcgggcagatcgtcgaactcactctcgcccggatcgtgccgggtgccagcgccgacgtggtcaaggacgccctggccgggacgcgtcgcaccgcccacgccagcctctggagcaccgtcgcactgtgggtcggcctggctttcgccgtgctgaatctggcctcggcgatgggccaggtcgagcgaggtgccaaccgcatctacggcgtcgagcaagaccggcccgccctccacaagtacggccgctcggtgctgctcgccctcgccgcgggcgtgcccatggtcctcggattcctggtcctcgtcgccggccgggccgtcggtgaatcggtcgtggaggcgttcggctggtcccacggccggctcgactggtggggaccgctcgaagtcccgctcggagcggcgctcgcctggatcgcttccgccgtgatcctgcggtggtcgccgcgccgggtgcagccgggctacacctggcttgccttcggctcagcggttcatctggtgctgtgggtcggcgccacctggctgctggcgctctacgtcgccaagagcggttccttcggcgccctctacgggccgctcaccgcgttcgtcgcgctgctgctgtgggccaatctgaccggtgtcgcgctgttcctcggcatcgcgttcgccgcccagctggaggccgcccgcgccggtatcacctcggccgtgaaaccggatcccgggccatgagcggccgcgcggtgacgaccgtcgtacgggccttccagcgccctctgtccggttcccccgcgtcgaggagttgccggatgacgctggtgctcgcgaggccgacgatgtcaccaccgtcccactgacgcagttccttgacggtgtcggcggggtcggcggtggcgaggcgcgcgttgtcccgacaggccgatgttcgcgacgacggtacggtgccgaggggttccggcggcggtggtcatggctgactccttcttgccggtggccgggcgaggggtccggacgcccgggatgacctgatcagggcgtgaggggcggtgcctgcaccgcccctcaccgcttcacgaggccaggaacgcggtgagcccctccaggagccgctccgcgtcactcgcgtcgttgtagggcgacaggcccacccgcagaccgccgctgtccccgagaccgagatgccgggacgcctccagggcgtagaaggatccggcgggcgcatggacgcccagccgtgccaggaagtggtaggcccgcgtcgcgctgcggtcggcgaacgtgagcagcagcgtgggggtgcgctcggctgcccgggagtggatcgtcacaccgtccagcagggacagttccttctcgatgcgctcccgcaacgcggtctcgtgccgttccacggcggcgtacgcggaccgcaggcgatcacgtctgtctccggtgacggcggcgccggtggcaaggccggccaggaagtcgaccgcggcccgggtgccggcgaggaactcgtagggcagggtgccgagttcgaagcgctccgggacggcgtcggtggaggggagcagtttgtcggggcggagcgtctccagcagttcgggagaggccgcgaggaccccgtgatggggtccgaagaacttgtacggcgagcacacgaagaagtccgcccccagctgcgtgacatcgacgaagttgtgcgcggcgtagtgcactccgtcgacgtagagcagggcaccggaccggtggaccaggtcggcgatctccgcgacggcggggcacgtaccgatcaggttggaggcggcggtcaccgcgaccagccgggtgcggtccgacagcacctcgcccacggccgcggcgggcagctcgcccgtggccgggtcgaagtcggcccaccggacatggacaccggcctgttcggccgcctggagccatgggcggatgttggcgtcgtggtccagccggctgaccacgatctcgtcaccgggtgcccaggtcctggcgagtacgcgggagaagtcgtacgtcaactgcgtggcgctgcggccgaggacgatgcccggggcggccgcgcccagcaggtcggccatcgcctgccggaactcctggacgatcgtctccgcattggtctcgccgagcacctccgcgccccggatcgacaacgggttgctcatggcatccgcgatggccgcgatgaccggctcgggtatctgggtgccgcccgggccgtcgaagtgcgcggtaccggcccgcagcgcggggaattgcgcgcgaagcgcgccgacgtcgtaagtcaccggcccagcctgccaggaccgccccggaaagggccacggcacgaaacgaactggccatccgccgcggcgcgtgggagaggccggctctcaggtcggcctgggcgcggagggtgcggtcatcacccaccggatggtcctcgtcagtgcgtggccggccagtcggacagcggtgggctcgagtaccgggacccgcggaaggccgagcgggccgcgcgcccatggcggcagatcggcgaccgcgttcgccgccaggacggcgtacggcggccggacggccaggggcagtggcggatggaggaggaggaaacgggccgccgctgcggcctccgccgtggcccgcagctcgggacggtacgcgtgcagccgctcgaccagttccgcacggttcctcggtggattcagcacaccgagggcggctgcgatgtgcgcggtgtcgtcgacgtacccgtcgcagccggcgtcgtccagcggttgctccccgtatcgctggtgggcgcggagaaagctgtcgacctcggcgacgtgcacccagccgagcagatgcggatcggccgcgtggtacggctcgcccctgtccgtggtgccgcgtaccgcctcgtgaacggcacggacgcggtcgacggccgcctgggcgtcgtcggcggttccgaaggtggtgacggcgaggaacgtgctggtgcgctggagtctgccccagggatcgccctggtatccggagtgggcggccaccgcggccatcgccaagggatgcagagactgcagcaggagggcgcgcagtcctccgatgtacatcgaggcgtcgccgtggacggtccggatgggccggtccggcccgaaccagcgaggcccgggagcgtgatggatgcggtcgcggttcgcgggcccctcggggccggcgacacggctgaaaagcatcgcgcccagccgttcgcgcaccccggagaccgcggatgcgtacctttccattgctccattgtccgacatgagaaacgcggaggtcgaccgacaagcagcgatggggcaatggtgcaacggagcaatggggcaatttatgagggggcggaagagatcgcttgccgaatcacacggaaatggtgcgcaccggattcctccggtgcgcaccacggcgcagcacgaaacgccgggcgatcagcctccgacgtaccaggcgaaaccaccgttggacgcggccacggccatgaaaaccgcgaacaggatcaggtccacgatgcccagcacgactccggccttcgccatgccgccaccgcccttgccccccgcctgccgcagggcgaccacgcccagcacgatggctatcgggccgaggatcacgctgaggaagaaaaccccgacgatcccgcagatgagactcgcgatcgcaagaccgttggtgcgcgatccggaggaggccgtggagggactgccgtaactcgtcatcacattctcccgctcttcggtgtggtgcacgttgcgacgccttctttccggaccgtccgaatgcccgggaaatgccgacgtattcccacggtgcgtcagacacagcgggccgggagccaggtttgcgctcgcgcggttcgtcggagtgctccgccggatccggggcatgagacggggtgccgccgacgcttccgccccccgatgggtcggcggcaccgatcacatgtgggacgaaggagaggggccgcccctccaccaccggtcggcggcgcctgccgcacggaaacaggagaaaacgcatgctcgagtcggttgcagctgaaccccggcgcgccgcggcgacggaccaggcgggcaccgaggcacgcaagcagcgtctgcgaagacgtctggagagactcatcggtatcgccgcgaccgagggcaacgagctcgtacccctgcgcaacggtgacgagatcttccccgccatgctccgagccatccgtacggccgagcacaccgtcgacatgatgacgttcgtgtactggcgcgggcagatagcgcgggacttcgcggccgcactggcggagcgtgcccgcgcgggagttcgcgtgcggctgctcctggacggcttcggtgccaagcagatcgaggagggcctcctcgagtccatgaactccgccggcgtagaggtcgcctggttccgcaaaccgctgtggctgtcccccctcaagcagaaccaccgctgccatcgcaaggtgctcgtcgtggacgagcacaccgctttcaccggcggcgtcggcatcgccgaggagtggggcggcgacgcccgcaatccctccgaatggcgcgacacccatgtgcaggtccgcggtccggccgtcgacggcatcgccgccgccttcgcccagaactgggcggagtgccacgacgagctgttcgacgagcgggaccgcttcaccgagcacgagcagtccggtcgggcaaccgtccaggtggtccggggctcggccagcttcggctggcaggacatgcagaccctcgtccgggtcatgctcgcctcggccgaggagcgcttccgcctgtccaccgcctatttcgcgccggacagctacttcgtcgacctgctgtgcgcgaccgcccgccgtggcgtacaggtgcagatcctgctgcccggcccgtatacggaccagcgggcgtgccggctcgccggtcagcactactacggcacgcttctggatgccggggtggagatccgccagtaccagccgacgatgctccacaccaagatcatgaccgtggacggggtcgccgccctgatcggctccagcaacttcaaccgccgctcgatggagcacgacgaggagatcatgctcgccgtgctggacgagaccttcacggcggccctggaccgggacttcgaggaggaccgggagcgggccgaggccatcgtcgcggcacgctggaagcaccgctcccctgtgcagcgcctcaaagaggcgatcgtcgctcccgtacgccgtttcctctagcggacgggcctttgcacacgccccggtgtcggtccggtgagggcgcctcacggcccctcaccggagggctcgaactccggccgcgtcaccggctccggcgagggcatcgactacgaccctgccgactgggcggagccgcagccgacccgcgcgcgcggcgagagccggcgcccgctgcgctcacccctgccgcgaggcggtcctgtccggcgcgtgtgcggcccactccacgatctgtaccgcggcgcccgcggcctccagcccacggcaatgtgcgtgatgccggcgggcgatgccgtcgagatcgaggtgggctccgaaggcggggtcgccggccagccgccgcgcgtaggcccagagcgccgggtgatcggcgacgcggtgcacagcggaggcgtccaggtgccagcggtgcacggtgtcgagctgcaccaggctcacccacaactcgatgtcggccgcggtcaaccggtcgcccaggaggtagtcctggcgggccagccgcccttccagcgaacgcagcgtgcgcagcagggagcccagcgcgctgtcccgctccgcgtcgtcggcatccgcgcgtccggcccgctgggccgtcgcgttgatgccctgctcacacagatgtccgacggcctcgatctccgcctccatgcccttcgggtacagcggaggccgctccccgccgaaacgccgggccaggtcgcgcatgatgtccggcgcgtgcgtgctcacgatccggcccgaccagtcgtcgctgagcaccggcgccacggcggctccggcataccggtgcgcactcgcctcgtacagcgggcgtagcgcggagtgctctccgccgggtccgtcgggcaccgcgggcagcagcgtcaccgggcaggcgtcctcgagtccgagcaggctgtgggcgacggcgatcttcagacagtgcggacacgacggcgacaggtggaggcgataccggcccggcacgggatagtggccgctgcgcgcgtcgcagccgatcctcccccgaaaggccgacgtggccggtatggatcgtgcggacggaactgcggtcaaggcgttgacggacatgtctctccccggggtctggcacgcacaggtgcggagggcgaagggcgggagcggagtcgtcggctcggcgcgaacggcggtgcccggtgcggaactgaggtcccggtacggacggccgggacacgggcgccggaccggcaccgccggttcagcgcagtcggccggtcgcgctgcagacacgcagcagatcgatgtgacggcgggaggtcaggtggagcgtcggccgacgtgtgcggttcacactgtcgatgaccggctccaggcgcctcatgcttccctacctattcactaggaaatcccctctggagtgtcggtccgccttccgccgcagtcaagaggtgtctcacggacggcggtccgaccccgcagccctcccccgccgggacggccacgaccgaggacggcggaggcgagtcggacacccgggcggcccgggcggaagggactgagctgtgggggatccgccggcgcggcggtccggtgacgggccgacggtcgaccggcgggcgcgggcgcggaccggccgcccggcaggggtggttgtcgccgctgtcgcccggcggcctcgccgagcccgagcggacctccggccggctggagggcgtcggctcggggtggtacggacgaggggctctctacactgctctggacctgatcgaccaaccgggggacggacatgcgggtacgcggtcaccaagtgctgatcctgacgtgcgcagcggcgctgctgggggcaacggcggcctgcggcggggcagggaccgccacgaagcggcccggcaccgcccgcaccgcaccttcacatgcccgcttcgacgcggagatctcgctgcccgacggccgccgcgtaggcatgtactacgccaccggacgcggcctcgtggagcagcaccggggcaccggcagcgcggcctggagcacaccgcatctgctgcaccggaccacgtccgatccctgccagagcctgcggctcaaggcgttcgggaccacggtcgcggccatcgcgaactggggggtgtactgcgccgacggtgaaccaccgacggagtccctcgccgcggtcggtaccggaaacctctcggagtgggacaccgatgtcacccccgacttcgacggttgggatgccgtgaaggcctcggaagagacgggcgagctgagtttcaccaatggctccgtcgagtcggtcacgaggctgcgctggcgccggacggaggggttctccgacgtggaggagatcccccggtgagccgtcccacgcatgacgacccactccgcgccttcgcggacgaggacacgtctgcgcgaagagccgccggtccgggagatccggttgctccgcgtggatgcctcggaccggttgtcgaccaggccggcccgctccgtgcacgacggaaccgggcttgcccaccacgtgtccggagacggccctcccctggtctgcctgcccggagaccggttcgtggccgccaccgcgccgttcctcagccgagccagggcctcacggtcagccggccaccgcgctcagctgctgcttgacctgacgcgacagatcgtcggccaggatttccggcaggcccttctcgatcccctccagagcctgggcggcgacgagcgcgggggccgtcttctgctccggggccacgtactcggccatgtcggtgtccatgtacccgacgtgcagagcgctgacggtgatgccgcgcggcgccagttcctcgcgtaccgagtcggtcagcgaccaggccgccgccttgcccgcgctgtaggcgccgtagcccgccgggtgcacccacgacaggaccgagagcacattgaggatcgccccgccgccgttggcctcgatgaccggggcgaaggcccgggtcgtctgaagggttccgaagaagtgcgtctccagttccaggcgcacggactccagatcgccggaaaccagctgcgtgtgcgtcgagataccggcgttgttcaccaggagcgtcgcatcggatgccgtacgggccgcctcccggaccgactccgggtcggtgatgtccagacgcagcgggatcgcgccgggcaggtcgaccgtctccggtcggcgggccgccgcgtacaccgtggcgccgcgctcgaggagctgctccgcgatatggcgtcccagcccccggttggctccggtgaccactgcgacggcgtgcttgagatccatgattctttccccttcgcgggaggtgcggggccgaggggacgacccttcgggtggccccggaggcccctcgttgaccttcaacggttatagattacgcccataatctaaaaagggaagagggagccgtacgatagatgtcagcgaacatccaatcgtggggaggtggcccatgggccgcgtatcgaaggaacaggcacgcgagaaccggcagcgtgtcgttgccaccgcctctcgcctgatgcgtcaacagggcaccgacggtgtcagtgtcgccgacctgatgaaggccgccgggctgacccacggcggcttctacaagcagttcgcctccaaggaggccctgatcgacgaggccaccgcgcatgccttcggcaccgtggaagaacagctcggcgacgggctccaggcccatgagggcgactccgccgcagctcgcacagccttcatcgaccactacctctcccccgagcaccgcgacgacatggccgacggctgccccacggccgccctcgccgccgacatggcccgcggcccggaggaaagcgccgcgcacgagacctatgtcgagggagtgcgccgtttcgccgctcggctcgccggcgccgacgacgacggcctcgcccgtctgagcaccctggtcggcgccctcgtcctcgcccgggccgtcaaggacgacccgctctccgacgacctcctcgaggccgcccgccgacagctgctcccctgacgcagggcggtggcccggggcggcgccaccccaccggccggcgccgccccggccggtcacccgtcgaccgccccgccgaaacgggccgcgctccccgcagtgcccggcgcgccggtcccgtacgggcacgagacgacggcaaggagccccttcggccccgcgggccgcatccacacgccccgtcgagcccttcgttcgaaccgcccggtgacgaaggtgccgggcggcgccgacccgtcacagctcgaagctcacgaacccgtcctcagcgtccggtgccggtgccgtcaccgtgtagccgaagcggtccttgaggctgtcgacgtcccatatcgccgcgcgatcacggtagttgaacacgatctccttcttcgcgccgccgtgcttgaggatccgtgcgacggcgatggcgttggggtggtcgtgccgggcgccgctggtcgatatcaggtagcggtcgcagtcgatcagatcaagcaggtccttcgagaggttgtgatcgctgccgtggtgggccaccttgaggacgtcgacgtgcaggcgtccgccctccgcctcggccctgggccgtatcgaccgcaccagccgccggtcgtcggcgtcaccggtcaggatgatgcgcttgccctcgaactcgaagagcaggccgatgctcgtgaggttggtcttcgacgtgtccggccggaacgggcgtgcggccagctcctccacgttcactcccccgaagtgctcgaagccgggcaccagggggatctcgtcgggatcgcggcccgggatcaggccgtgcttcgcgcattccttgacccagtccggcgccaggctctccagttgaccgcggtcgggcgagagcacgtccaccgtggatccgtcgtcgaaccacacgagctcccgcccgacttcgacactcagcccgccgaacgcgtcgttccacggcagcttctgctccacaagggcgctggtgagcttctcgccgtcctgagcaccgaacccctcgaactcgaggaggtgatcgaacccgttgaaccacacgtccccgaactccaccgatctgtcggggtcgttcagcagggcgagcacgcccagaaggtggtcctggtcgacatgggtgacgacgaggacgtcgaccagaccgtcgaggcccgcgagtgtgggccggatgcgcggatacgtgccgctgcggccgccgtcgaggaggatccggcgcaggaaggtgccgtcgccgtactccagcagcaggcagtcgccgtcctcgccgggcatcatcgtgaaccggatcattgcggtctccctcggagggcgacgatcacgaagggctcgcgcaggtcgacacgccacgacaggcggcgagcctggtcgagccgccgagcgcactcggggtcgtcggggaattcggagagtccgtggatgagccggctcaggcccagggtgaagaccggcacaccgcggtcgaaggcctcgacgagcccgtcgcgggccgcccgcaactgcgtctcggtgtgcgcccggcgcagctggcgcatggcccacagcagggatccgtcgcccatccagtcgaactcgtgccgcagatggtcgagccacgggtcccagcgctgtggacgttccgtcagctcgctgccgaccagcacgtacgcgcccgccaccgccgcgagcgggttctccatcttggcgtagagcaatgcctccgcgtccctgaccagggtcgccgccgcgtcgaaggcgcctcgggacatgtatcccagggcgggccccacccggcggtcccgcacggccaccgagaccgcgctgccggtgggactctgacgctcgttgaccagcacctcgatctgcgcggagccccatggcgccggcagggtgacgacgtactccttgccggccagtgagacgaccaggaactgccgagggcccgtgggcccgccccaccgtgtgggcgtgccgtgctcgtcgaccggtccgtgcgcgccgaaccggtacaggcgtgcggccgcgtcacccagcgcgagactgggaacggaccggggcgcggactgggcgatctcgaagacggtcggccgttcggccggcccgtcggccagcttgagcatcgagtcgaagtggtaactcgtgggcttcgggtcgccgacgaacaccgcgtgccccggttggacgagcccttcccacaccccggagcgcgacccccgggaccggggcacaggaatcgtcgcactgtcgtgataggtctcgtaggcctcgatgttgcccatgaggtactgccaggaatgtgacgcgtagggcgaaggcgccgtgcgcagcgtcaccggggtgtcctcgccctccctggcctcggcatccctggaaagcaccgtgcctgacggcagcgtggccgacacgatgtaccggccgggatcgacctcgtaccgcgccggcacggccgacatcccgcaggggaacacgacgttgcgatgggtgacaccgttgccgtcggtcgagtagatgttgccgacgaccttggcgccggcggagaggtcggattcgtcgagggccagcgcgacggtcacgctcaggcagccactcatgacttcaccaggtgcacccggcggaacaccgggcggacggtgatggtcttcgtccgtacgtcccgctcgccgagcctcgcctcgaagtcgtagtcgccgaagctcagttcaatggcccattcgctctccggatcggtgtcgtcgacgtcgttcagtgtccggcgcagccgctcgcgtccgccttcgaggcacacgaactcggcctccgcgttgtcctgtgcggggtcgcagcccacgtagaccgggacgaccggcggaccggccagctggtggaggacgaacaccggcagttcacccaccgcggggacctggacgcccgcgaccatgccggcgaagcagggctggtgcatgaagtggtcgatcgcctccagcagatgggcggtgttgacccgccagtcgccttcggggtcgtcgctcgccgcaccggcgaggctcttgagcagcgcctccgtgaacaggctcacctgcccgggccgggcgtgcgactggtcgccggacagggtggcgtagtaagggatgtggaaccgtcggggaaggtccagcggtcgggcccccgccccgagcggcgtccgtccggcgaagcgcgtgcccgaagcctcgatgagcacgtcggagttggagcggcaggcgtcgaggaagaagacctgctgggaggccttgcagcgcttgagtccgttcatcaggcccgcgaagtccagtgcgccgttgagggggttgtgcgggtcggcgaagatgtcggcggcgaggagcgccatgtcgtcgccctgcgagatgccgtgtccgcagaagtagaagacgagccggttgtcgacgtggctgtcgccccggtcgtaccactgtgtgaccgcggcgaggatgttgtcgatggtggcgacctcgacctcgtgggcggtcccggtacgggggttcacgaacggggccggctgttcctcgctcagcagcagcgagacgctgccgagcggccgctgcgggtcgtggtactcggcgagcagccacctcgcgaaggcacgggcggagagaggcggtgagctgagctgccgcatgccgtccgaatccgctaccggagcctcgccgccctcgagatgggggtatttgccgacaccgacgaccagtccgtgggtggccggaggcccggcattctcatcgaggtggatcacagaaccggccatggatcctccggagacactccactctgccggagcatgcccgcaggcagaatttctcctattatattccgtgaaaactgatgcgtcctggtttgttccgtggatgtccttcatcagcgaacgtgaggcccgacatggccgagaaccccggcggcaccaatctggtcgtctgcctcgacggcacgggtaaccaattgaaggcgaaaggaaataccaacgtcatccggctgtacgagatgctggacctcgccgaccccgaacggcagatcgcgttctacgaccccggtgtcggcaccttctccgccgcgggcgcgtggacgcccgtcagccgccgtctctcgagactcttcggtctcgccttcggctccggaatgaagaccaacctggccgaggcctacacgtacctgatgaaccattacgcgcccggcgaccgcatctacatcttcggtttcagccgcggcgcctatacggcacgcgcccttgtgggcatgctcaagacgatcggtctgatgcggcccggcatggagaacctcgtgccgtacgccgtgtccgtctacgcgaagaacaaggactggacccagaaggactgggaccaactccaccacttcgcgggcgccttcagcaacgcggtcgacgggcggatcggcatccccgtccactacctcgggatctgggactccgtgaaggccgcgggtgtcctgcggtggaacctgcggtggccgtacacccgtcaactccccaacgtccgaaggatccgccacgccgtgtcgatcgacgagaagcgccggccctaccgcgagtacctcgtcacggcgggcaccaagaagcagacggcgccggcctcggtcgagcaggtgtggttcgccggtgtccactccgatgtaggcggcaccttcgacgacgacccgcggctgcccaccgtctccctcaagtgggtcgtggacggcgccctcgcggcaggcctcctcgtgaagaccggggcgtacgcgcgtgaggtgaccctcggacccgagcacgcgctgggcgaggtgcaccggatgggccggatctgggccctgctcagctaccggcaccgcagggtcccgccggacgcgcatgtccacgcgagcgtgcgggcacggctggcaggggatccgggctacggggaccggatcccggcgacggcggtctgggccgacagcgactggctcagcccctcgccggaatcggcgccgcggcgggcgacgcccgacgacggaacccgagccgcctccggtcccctcggcggacgaacggcggcaaggcgtccgccccgctggtgaacagcaggccgccgggcacgcgtgtgcagaccggcccggcaggcgcacacggctcggaacccgctcgacgacccacgcgtcccgagcacgggtgaccgcttccccgcccgcggacgggggctcaggtggcgggaagtccgcggcccggccggtccgacgcgtccctgacgccggacaggcgaagaagcggccgccgcccgtcagggagatgccgggatcggcccgctttccgggcgtcgtcccggaggccctccgggcatgccgtcgtaccgtccagtaatatcgcgcggcaggccccctgaggaggaaccgtgtcccggtcggaacgctcatccctgctactcgccggcctgttggccaccgcgggcgtcgctcacttcgccgcaccacggcagttcgacgcgaccattccgcgcgctctgccggggaagccccggacctggacgtacgcgagcggcatcgccgaactggcgctggcggccggggtggcgctgccccgtacgcggcgtgccgcggcgctcgccaccgccgccttcttcgtcggcgtgttccccgccaacgtccagatggccgtggactggcgtcaccgccccgcacccctcaggaccgcggccctcgcgcggcttcccctccaggtgccgctcgtgctgtgggcgcgtggcgtggccaagggcgcggagggccggtcatgacgcgtcgtgtggatgtcggcgacaaggtcgaggacttcgtcctgccggacgagaccggtacgccccggcaactgtcggacctggtcgccgacgggccggtggtgctgttcttctatcccgccgcgctgaccgccggctgcaccgcggaagcatgccacttccgggatctggccgcggagttcgccgccgccggcgcgcggccggtgggaatcagcggtgatccggtcgaccgccagcaggagttcgccggacagcacacgctcggcttcccgctgctgtccgacgaggacggaacgatccgtgagcggttcggcgtgaagcgcggcttctccctggcgcccaccaagcgcgtcaccttcgtcatcgccgaggaccgcacggtcctggaggtggtgcgcagcgaactgcgcatgagcgcgcacgccgaccgggccctcaccgccctgcgcgcgcaccggagctgaatcacaccccggagatccggacggtttggcccggccgctcgggatgcggcggggccaaaccgtccctgcgagcagggtcagccgcgcgctgcctgtgtcccgcccgtcgcccggcagccgagcgccttgaggtcgaccgcgtcggccatcgcctgcatccccttgtcgttgggatgcaggtggtcgccgccgtcgaagaacggcaggatccgctgctggtcgtacggactgcgcgtgatcttgtcgaaatccgtcacggcgtcgagcgcgccgctgttcctgatccagtcgttgacgccctggcgcacggcctcggaggcgtcgtcgtactcgtaccagcccttgaacggcatgacggtcgcgccgacgacgcacttgcccgccgtgtgcgcccggtcgatgatctcctgatagccggcgatcatgtcctccaccgtgacgccggagtgggccttgatgtcgttgatgccttcgaacaggaacaccgtgctgaccccgggctgggagagcacatcacgctggagcctcttcagcgcggcctcaccggcgccgtccgcgagcaccttgttgcccgaaatgccctcgttcgccactcccttcacagtgctgccggacgcggcctggagccgtcgggcgagatagtcgggccagcggcggttcccgtccgtggtcgaggcccatccgtcggtgatggagtcgccgagggccaccaccgagctgaccgccgtggatgtctccacatcgacggcgtccagccagtaccaggagcccatcgggtcggtccagttggccgcgccctcctcggcggcgtggtcgcccgcggtcgcgtaattggtctgcatggccatcccgtgaccggtcgtcggtccctgggcgcctgtcacgtacaggctgacgaccagatcgctctgagcggccagctttccgggcagcggatcgctgagcacggtctcaccggccgggacggtgacggacgcggccccgtcgaaggacagcttccggttggagccgtggaccagctccgcaccctgcttccgcagccccgcgtacgcgttcgcgaaggtcaccgggtggtcaccgaaggcgttggacagccggatacgcatgttcgtgccgccgacgctggtgcgcacgatcaaccggtaactgcggtcggcgggcccggcgctctgccggtcggcactcgcgccccaggtgaccacggagtgcttggactgcgcggcggccggggtccccgccgtgcccgtcggcgcttgcgcctgcgtctgcgccgacgaggagaccgtcaggggtccgcagaccgccaggatcaccgctgagacgacgcccgccgcccggcgccggtacgaggcagcgctcatccgaggttccgcagcgtgacggactcaccgggcttgaggctgatcttccgcgaggcgccgcccgcgacgacggtcgtgcggcggccgcccacgctcttcagcgtcgcccgggtgaccttgccgttcttccagctgagatccgcgacgaagccgccgcgcacgcccacgccggacaccgagccggatgccgcccaggcggcgggcagcgcggggagcagctcgatatggccgggccgcgagtagaccagcatctcgacgatcgcggcgggggtgccgaagttcgcctcgatctggaagatgccgcggcccgtctccacctcgtagatgtcgaagaggttcatcgcggtgccgttggttccgttgaccgacggcttcaggttgttgacgaccagctggtacgccttgtccgcgttcttcagcctcgcccagcacaggctgcgccaggcgttggcccagccgaaactgttcatgccgcgcgccgtgaggagggcggtcgcgccgtcgacgatgtccttcggcgtggagccgtccggacggatgcggtcgccggggaacaggttgatgagcggggagaggtgccggtgcgtggtctcgccgaggttgtcgggcgacatccactcctccagccagccggtcttggggctgaccacgggcaggtacaggcgctcgcgcagaccgtcgacggtcttccggtgggcggcgtccttggcgagcagctcggaagcggtgtggaagtttccgaagaggccccacaccagttcctgggcatacgtgttgcccttggcgtcctgcgggccgtgctcgggcgaccagtcgctgtcgtcgatcaggacctcgcgcttcgcgccggacgcgtcggtgacggtcgtggtgatgagacgtgcgtcccagaactccacggcgcccttgaggagcgggtagatcttcttgagataggcgcggtcctgggtgtactcgtagtgctcgaacaggctctggcagagccaggcgttgccggccgggtgccaccaccagccggacccgccataggggttggtggagaaggcgacggtccagccggcgaccttgccgctggagttgcggtatcggttggtggagtcgttgaacagccgctgggtgacgtccgtccaggaggacaactgcgcgaggcagtagtccgtgaaggcgtcgaaacactcggacaggcccgcccggtccgccatccagtagttcatctggatgttgatgtcgctgtggtagtcggccatccagtccgggtcgttgccgtccagccacgggccctggaggcccatcggcaggctgccccgcgatccggagatcatcagatagcggccgaactgcaggtaggcggcctcgagttccgggtcggggaggtcgtcccggtggcgtgcctgcagccgctcccaggtgtccagttcgcgctgcgcggcggacgaggtgccgaggttgatgtccagctgtccgaacacggcgcggaagtcggcgacatgtgtgtgcagcagggtgctcgtcgggtggccggccgccttgaggaccttggtcctggcgaggcgctgcgggtccacggaagggtcgcggaacttcgcggccgcgtcggacgcgtagttggtgccgccgctgacgacgacggtgaggtccttgcagccgctgaaggagatcgacgtaccgtcgacgcggaccctgccggtgctgctgtgggcggtgacggcggcgccgtacttcaggccgttggcgaaggaggcgccgaacgacgcgtagcgccccgcgctgttggcggtggtggactcgccgtgggtgccggcgagggagacggtgcccgtgtaggcgccgccgccctgctgggagaagtacaggacgatggcgtcgtcggggcggctggcgaagacctgccgccggtaggtcacgccggagatgtcgtacgaggtgctgaccaggccctgggccatgtccagggaacggcggtagttgtcgacgcttcccaggtcgtggtcggggatggcgaccgtgagcttggccagcagggtcaaggagccgaagtcgtcgcggccgtaggggaactggccgtcgctctggagcttgtcgttgagatggccggtccacagggtggcgtcggtgatcatcagaagttcatgggcggggtcgttgctcgcgagcgccccgaggcgtccgttcccgaccggcagcccctgctcgatcatcgagtgggaggagccgggagcgccccaccacagctggttcttcgcggcgtcggccgcggacagcatgggcgactcggtggggcggaagggggccgccgaggcggtgaaggcgggcagaccaccgagtgcggtggccgcgccggcggcggcgagagcgaggaagcctctgcggctgggtttgttgtcgcgtggtgcggtctgctggatgtccacggtgggtgcactccatatccgggcgcggctcatgcgggaacgacggttgcggggccgtctgggggtccccgcggggcccggggtcaggtcaccgggccccgcgggaagcaggtcggacggactgcggacgtcagacggactgcggaacgacgatcctgtcgatgtcgggtgcgtatccgctgccgctgtcgaacgtgatggtgttcgagcccgccttcagtgccagttggacactgacggtctcggccgtgctccagtcgcccgtggaggggaacttcaggctcgtgccgttaccgctgttggacaggacggtcaccgagcgggggtcgccgctgacgtaggcgaccttgacggtgtagatcccgtccttcttcaccgtgatgtcgttgatccgcagcttgccgccggtgtacaggttgccgaccttcttgccgccggagcaggcgtcacatccgccgacggaggcgttgcccgacagggtgttggccgcggcctcggcctcgtagcccgtggtcgccagggtgccgccgccgggcttgatcgtgaacagccgcgagccatgtgcgggcagcgcctcggtgatcttgttcttgtgggtcccgaggttcgtcttgttccacaggtcacgcacggaggcgttgccggtgaatccgaacgaagcccagtgggcggtgacggaggccggcgagtcgccgaggttgaacagggcgacggtgtagctgccgtcggcgttcttggtgccccagacctgctggtcgccgaccggggtgaccggacgcgcgacgggcgaggtgttctgatcgacggcgatgacttccttgttggtgagcagggagacgccgtagctgtccagcttggtgaggtcgtcaccggtgaacagcggcgacttgttgatggcccacagcgtcatgtagctctgccgctcggccttggtgaggccgtccatctcgccgttgccgacatcgatggcgtcgaggtcgttccagccgccggggcccgccttgctgctccacgccggggcgtcgtcccatcggtcgttgaccgagttctcccaggtgaccagggtgttgcagtagcactcgatgtcggtgtcgatgcgccagccgttggagtacttcttccagtcggcggcgtggccgatgtcgagcgaccaggagagctcgaggtggatcgggcggccggtggcggcgatggccttctgccaggcggcgacgtcggcgacgttgttgtagttgtcaccggacttgaacgagcccgggcccaccccgtccagcttgaggaagtcgtagccccagtccgcgaacatctgcgcctgcgagtcgatgtacttctgcgcgcaggacttgtcgaagtcgatcttgtaggcgttgtcccagccgttggtggtgcgcaggtccgagtagacgatgtcggcggtggtgcagccgggggccttcgagatcggcgtcttgccgtcgccgtacgcccccttctccaggccgacgggcaggtagatgcccgccttgaggcccttggagtggatgtggtcggcgaccgacttcatgccgtgggggaagcggaccgggtcgggcgtctgccggccgtactggtcgaactgggtcttccagttcttgtccatccaccagccggcgtcgatgttgacgtggtcgtagccgtacttcttcagcttcgaggcgagggcgtccgtctgcttcaggacgttcgcctcggtgagatagctgtagtcgccgtccgggttgaggcccgggtacttcgacgactgcatgctccagctcgaccagcccatgtacggcttggcggcgaccggagcggcggcgggcgtgctcgtgtccgcctgggcggccgggacgaccgtcgcgacacccgcggtgagggcgaggacgaggacggctcttatggagcggcggccggagcgcggggcggctccgggtatgacggcgtacgaggatgaccccatgggtcggacctcctgggacgatgacagcgggggcggttggtgcggggcggctcttgccccggcggtcggacggcggctcagcccttgcccgaaccgatggtgagtccgctgatgaattggcgctggagcgcgaagtacaccagcagtgtggggatcgcggtcatcagagcaccggccgcgatgaggttgggattggtgaagtacgcaccctggaggttcgccagggcggaggtgacggggcgcttgtcgccggtctcgatcagcgcgagcggccagaagaagtcgttgtagatccagatcgattcgagcgtcgccagggccgcgaacgccgggcggcacagcggcaggatgatctggaagaactgccgccacacgggggcgccgtccacgagcgccgcctcggagatctccttcgggatcgtcttcatgtagttgctgagcaggaaggtgcagaacccggactggtaggcgatgtggatggcgatgatgccccaggccgagttgtagagaaggagcgagtcgctcatccactgcggcagcgggacgaggaggtagagccggtacagcggggtgacgaggacctgcgcgggcaggagattgcccgcggtgaacagcatcagcagaacgatgttccagcggaagtcgaagcgggagacgaagaaggcgaccgccgacgagaacagcagggtgaacagcaccgacgggaccgtgatgaggacggagttccagaagaagtgcggcatcccggactggtcccaggcgtccgtgaagttgtcgaagccgaggctgtggggccaggagagatagccgtgcttcgcggtgtccgagtagggccgcagcgacgtgtacatcgcccacagcagcgggacgagccacagcagggcgatgccgcccagcatcagatgacggcctgtctggcgccgcggcctcgatgaggtcttcggctgctgcggctcgcgccgggtccgcgggcgggaggccgggcgcggcacggtcgtggtcactggtcctccttgcggaagttctggacgaggaacgtcccgatggcggcaagggagaccacgagcaggacgaccgcgagggcggaaccgtaaccgatgtgactggactcgccgaggatgttgtcggtgatgaggagggacaggagctccatgcccggcttgcttccgattccgccgccgaggacgtagacgacgtcgaaggaccgcagggactccatgaccgtgatgaccaggatgatgacgttgaccggtctcagggccgggaagaccacccgcaggaaggtctgccgtccgttggccccgtcgagcgcggcggcttccttgagcgccgggtcgaagcccttcaggccggccaggtagagaatcatgatgtagccggtgtgccgccagccggaggcgaccaggacggcccacaggttgaggtcggggttgccgagccagtcgatgtggtggcccgaaccggccgcgttcaggaggccgttgaggagcccggtgtcggggttgtagatgatctcccagatgaagcccaccacggccagggagagcaccatcggcaggaagatcgcggtctggtagaccctcgtgaagcggatcttccggtcgagctggtaggcgaggaagatgccgaacggggtgggcagcagggccgtgaacagcagccaggccacgttgtgccgcaccgccggccagaacggcgggtagttggtgaagatctcctggtagttgtccaggccgacccagtggatgtcgaccaggtcgatgccgtcccaggtggtgaaggacagccacagggaggccagtgcgggcagccagacgaagaagagcagggccgcgagcgggatgccgatgatgacggtcagaaagatccggtcgccggggccgaggcggcgggggcgggcctttcgcggtgcgggagacgcgggcgcggaggacacggagggcgcggaggacacggtgcgggagacctttccggccctggtcaggcggtgaagaaacgcgagcgctgggactcgatcttcttcagcgtccctgcgccgtcgtcggggtggccgagccactgggtcaggccggggagcacgacggtggagatgaagcccgggtcgctgtcacggtccgcgaactggctgatgtgcttggcggaggcgatgaggtcggcggacttcttctgcagcgcgttgtacgagccggtgtcggcctcctcgttgacggcgaggttgctcgggtcgacgcccatgtacacctcctcggtgcgggccccgccgaggaactccaggaacttcttggcgccgtcctcgttcttgggccgccggctgagcatgaagccgtcggtgggggcctcgacggcatcctggccgtgggtggcgtcgatctcggggaaggggaagaagtcgatgtcgctgcggattttctcgtcggtgatctgctggccgaggaacagtccgatgacggccatgccggacttcttgtcgagcagcgactgggcggcgtcctgccaggagcggccaccggctccctgctggtagtgcggggccagttcacgccagtgatcgagcgtggcgacggcacgcttgtcggtccaggagaccttgccgcgcatcagggacatgtggaagtcgtagccgttggtccgcatgttgacgtagtcgaaggcgccgagaatgctccagctgtcgccgccgccgtatccggaggcgatcggggagagcccgtccttcttcatctgcttcgcgagcgcgatgaactcgctccacttctgcgggatttggtagccgcgctccttgaacacgctcttgcgatagaaaacggcccacgggtagttgtacagcggcacgaagtagtacttgccgtcctcgccacgcgagagctgcttggtggcgtcgctgaaaccggcgcctatcttgtcccacacctcgtcgagcgggctgcacagcttcttctttgcgaagtactgcatgcggtagccggcgaaccaggtgaagacgtcgtccggggtgccctgcagataggtggagatgcttttctggaaggtgtcgtggtccacggtgttcgtcttcaccgtcagaccgctgtccttggtgaacgccttggtcaccgcggcgtaggcggacttgggagtggcgtccgcgccgttggaaccgaaggtgaccgtcttcggatcggcccccgctcccccgccgcacgcggtcagaaggggcgcgcccagtactgccgcgccgaggccgaacaccccgccgaccaccgagcggcggccgggagtcaccccggccgtcgggggacggccgggtccccgcgcagccagggggttgcggctctgctgcgtcatcgctgctcctcgtgcatgtcagtacgtgtctgatctgatgaaggactgaatcgcggtggccgccgccccgcgcgcccactcctcgaagggcagcgggcgggtctgtaggtcgcaccgggcggccgacccgaaggccgccgcggcgaacgcctcgcggatctgctcggcgaacaggtcgtaggcggccaggccctcgcccgagatgatcacgcgttcgggacccaggaggttggcgaccgtggcgatgccgcggccgatcgcgtcccccgctcgggcgtacacctcgcgggctccggggtttccggcgtgcgcgaggtccacggcctccgcggtgtcggcgacctcgatgccggtcacctcgcggatcctgccgacgatcgccgagtcggcggcgatcgcctcgacgcatccgcggttgccgcagtggcacggcgggccggccgggtcgatggccacatggccgatctcgccggccactccgtgcgccccggacaccacatggccgtggacgacgagaccgcagccgatgccggcgccgacggtcaccaccgcgaagtcggacaggcccaccccggcgccgaaccactgctcggcgaccgtcagtgcccgtacgtcgttgtcgacggtgaccggcaaccccgtggccagcgaggccagttcggccagggggacatcgctccactccagaaagggcgagtagcgcacgacgccggcggcccggtcgacgtcacccgacaccgcgatgccgagcccgtggaccgcgacgccgaagccgtccgcctccgtcagcagttcctgtacgagggccgtgatggaggcgagcaccgccccggggtcgcgcgacgtcaggggcagatgccgggcgacccggatgcggcagcacagatcggtgagtacggcgatgagttcgtcgcccgtcaccttcactccgatgaacagcgcccgccctccgtcgacctgcaccgggttggcgggccgccctagcgacggctgccgcgcgtcgtcgtccgcgtcctccaccagatagccggcctcgatgagaggccggaccgccttggtgaccgccgccgccgacagccgggtccgccccgctatctccgaccgcgtgagcgggccgtgggacagcacggtggtgaagatctgggcggcggccggcgtgtgggccgggaacgcctcggtgcgagaggtcgagcgcatggccgggaacctatgacccttattttctgctgtcaatgaaagaagcaagattctcttgaggacctcctgtgtggcacttgctaccttcaaatacgagacttggttgggatgttgacagctgatccaaggtcccgattgacttccgtccgtctcatggcatcaccggaacgtgaggatccatgtcgctgatctccttcgccccgcacagcggggtctggctgctgaccaccccgcacacgtcgtacgcactacggatcgacgcgtcgggtgccccctgccatctcgcgtggggaccgaggctgacgctcgcggcggccgaggaactcgccgtccccgagccacccgctgccagcagcttcgagggcagaccgagtgtgggagaggaactccccgtcgacggcggggtccgctacgggccgccgtcgcttcaggtgcgcttcgcggacgggagccgcgccttcgaatggcagcccaccggccaccgggtgcacgagagcgccgacggcgcgcacgagctggtcctgttcttccgcgaccgccgctaccccttgcaggtggcgctgcattaccgggtgcgcgccgacaccgacgtcatcgaacggtggacggtcgtgcgcaacggcggggacgagcccgtgaccctgctgcgcgccgactcggccgcctggacccttcccccgctggcggactaccggctcagccatgtcaccgggcagtggtccgccgagagccggctgcgccgcgaccgactgccgtacggcgagaccgtgctgaccagccgtcgcggcatcaccagccatcacacgaacccctggctgatggtcgactccggtgaggccacggaggaccacggccgggtctggagcgcggcgctcgcctggagcgggagctggcgcatcaccacacagcgcaccccggacgggcggaccggcttcaccggaggcgtcgggcacgacggcacgggcgtaccgctgactccgggcgaggagttcaccgctcccgcgttcgccggcctgttcaccgccgacggcttcggcgcggccagtcgtgcctggcacgcgtacacgctggcccatgtgctgccccacccggacgaaccggtgccggtgctctacaactcgtgggaggccacgggcttcgatgtcgacgaggtcggccagaaggcgctcgcggaacgggccgccgccctcggcgtcgagttgtacgtcgtcgacgacggctggttcggcgggcgccgcagcgaccgggccgggctcggtgactggactcccgctcccgaccgcttccccgacggactgggcccgctggccgacagggtgcgcgaactggggatgcgcttcgggctgtgggtggagcccgaaatggtcaacccggacagcgacctgtaccgggcgcacccggactgggtactgcacctgcccgaccgctcccgctcggagctgcgcaaccagctcgtcctcaacttcgcccgccgcgacgtcgccgactgggcgtacggctggctgaccgaactcgtcggcgcccaccggatcgacttcctcaagtgggacatgaaccgcgccttcagcgaagccggctggccggggcagcaggacggcgcggaccggctcggcacgcagtacgtgcgccatctctacggggtgatcgaccgtctccgcgcggaccacccggggctgcggatcgagtcgtgcagcgggggcggcggccggatcgacctcgggatcctggggcgtacggaccagacatgggcctcggacaacaccgatgccgccgaccggctgtggatccagcacggattcagccagatctatcccgcgcgcaccatggggtgctgggtgaccgacgcgcccaaccagttcaccggccgtgggctcccgctgcggttccgcttccacgccgcgatggcgggggcgctgggcatcggcggggatctggcgcgctggtcggaggaggaactgcgggaaggggccgcgctggtcaccgagtacaagaaggtgcgccatctcgtgcagcacggcaggctcgatcggctgtcgccgccttccggccagtcgcccgcggtcgtgcagtacacctcggcggacggctcggagtcactggtgctcgcctggcgcggcgtcccgcgtcccggcgacgccgacctgccggtacggctgagggcactgactccggcggcccggtaccgcgacagccgcaccggcaccgtgcaccatgcctccgtcctgggcgactacggcctgcgcctcgacctgccggccggcgactggtccagcgtggcgatgcatctcgtacgggagccggaggcggtctgagcaccgtctctcgacgcggtccgtgcccctcccccagctccgatgcggcagagccggtgaagggacacgggcagtggtgcgggccgaactacttcgggcactccttccaggccaggtggtagatcgtgctgatgtcaccgtcggtcgagtccatcgtcatgaagctcgaactgccgggagtggaggtgccggcgttgacgcggagctcggtgttgatgttgaagttgcgctgaacaccgcagggggcccagaccagttgggcccagtccgtggtgtccgtggcctgccagttgtcgttgtacgggccgctgaaggggtgcgtgatggaagccgtgttcgacgagccctggaagtagtacgaggccttctccgtgctggtggcgccgcgctgaagggcggcgaagcctcggtagtccgcgctcgcgacggcgtacgtgaagccctgcgggacgtggacgagcaggttgagctggcagttcttgcggaacgcggtggggtcggcgttgcctccgacctgggccaggtagttgctgtacgtcacggtgaaggccgtgttgtccggcgagaccgcgaccgcggcggtcccggcggggcagccggagccgttcacggtggcgaccttgatgacgatcttgtccgggggcgggtcggtgaacccgcccgacgggtcccctacgggaagtgcggtggtgaagagggcggcgatcgcgccgctcaggagcagcccaccagccatggttctcccatccgttgcgttggcgttccggcggcccgcacacggatgtgcgggccgccgtgaataggggggtgcggcccgccgcgtgagcgaagagccgtcgcagaccacatgcgttggatcagataccgagacgtgctgtgccgtactgccctgcaccgtgcttcatgcgcatgccaaaacaggccgacatgcactccctacctgtgaaggatctgtggaggccgggagcgatcgcatcgtacgtatcccggcgcgccgcagacagggcgaactccagccaataccaaaagcgcatgcccacctgccccaccagcagggccgcgacgcggctccttaggctttcagccagtgaccgcccgttgcgacaggagcctcatgcccccgcacagcccctcggatctcccccgggcgcccggcccgccaccggccgaggccctcagctatggaccggccggagccacctgccccggcgacgagtcctggcacgcggacggcgaggggtaccgccgctacgaccggaccgtcgtcatcggacacggcgacgcccactggcgcgcggcagcggacgcggtcctccactggggcatcaagcggcgcagcggctttcgcgtcacgccccggtccggcgcgggcgagcgggtcaccgagggtgccgaataccggatcaccgcagccatcgggccgctcgccgtgcacgaacccgtccgggtcgtcgccgtggtcgtcacgcccgagcgatgcggcttcgcctacggcaccctgcccggccaccccgtctcgggcgaggaggccttcgtcgtccaccggactcccgacggcgcggtcgcgctgactctccggtccctgacccgccccgcgccgagcggcccatggcgcgcactgttcccgttgctcctcgtggcgcagcgcttctaccgccgccgttacctgcgctcccttcgcgccgtcgcaccccgctgacggcacatacccggtctggccggaatccgcgtccggaccgggccggcgagggggcaatctccgtgtcggttctgatcggaaccgatcggcatcgaaccgcccacgtgaccgaaattcgagtccgtacccttcttttcggatctcattcctggaaaaagcagcccatctttgtgaggtacctcgccgggccttcctccccgcactttgtttgaaagctcccaggtgagttaatctgccgcgtatttctcttgatgcggttcggtgatccgccggggatccgcgggcgatagaagtggggtgatcgtccgtgctccggcgtggttttcaggcctttcacaggagctcttggggagcgggacgagggacgagggtgggcatgaacagcaagacagccgaggccgagagccgcacaccgggtgatcaggagttgcgtcagctgctcgccggactgaccgcggtacgggacggggacttcggtacccggctgcccgacgacaccgacgggctgctgggcgagatcgccaccgtcttcaacggcatgatcgaccagttgtccgtgttcacgtcggaagtgacacgcgtggcccgcgaggtgggcaccgagggcactctgggcgggcaggcggaggtgccgggagtctccggcacctgggccgatctgaccgactccgtgaacgccatggcgggcaatctcaccacgcaggtgcgcgacatcgcgcaggtggcgaccgcggtggccaagggcgacctctcgcagaagatcgacgtaccggcgcgcggcgagatcctggagctgaaggagaccgtcaacacgatggtcgaccagctctccgccttcgccgacgaggtcacccgcgtcgcgcgcgaagtcggcagtgaagggcgcctgggcgggcaggcccaggtccccggcgtcggaggcgtgtggcgcgacctcaccgattccgtcaacctgatggcgggcaacctgaccgcgcaggtccgtaacgtcgcccaggtgaccaccgccgtggccaagggcgacctctcccagaagatcaccgtggacgcccgcggcgagatcctggaactgaagaacaccatcaacacgatggtcgaccagctctccgccttcgccgacgaagtcacccgcgtcgcccgggaagtcggcaccgacggacgtctcggcgggcaggccgatgtgaaggacgtccggggcacctggcgtgatctcaccgattcggtgaacttcatggcgggcaacctgaccgcccaggtccgctccatcgcccaggtcgccaccgccgtggccaagggcgacctctcccagaagatcaccgtggacgcccgcggcgagatcctggagctcaaggacaccatcaacacgatggtcgaccagctctccgccttcgccgacgaagtcacccgcgtcgcccgggaagtcggcaccgccggcaacctgggcggccaggcgaccgtacgcggcgtctccggtacctggaaggacctcaccgacaacgtcaacgtcatggcgtccaacctcacgggtcaggtccgttcgatcgcccaggtcgccaccgccgtggcccgcggtgacctgtcgcagaagatcacggtcgaggccaagggcgaggtcgccgcgctcgccgacgtcatcaacaccatggtcgacaccctgtccgcgttcgccgacgaggtcacccgcgtcgcccgcgaggtcggcaccgagggacggctgggcggccaggcgcacgtgccgaacgtggcgggcacctggaaggacctcaccgacaacgtcaactcgatggcgaacaacctgaccggtcaggtgcgcaacatcgccctggtgacgaccgccgtcgccaacggtgacctgtcgaagaagatcgacgtcgacgcccgcggcgagatcctggaactcaagaccaccatcaacacgatggtggaccagctctcctcgttcgcggccgaggtcacccgcgtcgcccgcgaggtcggcagcgagggcaggctcggcggccaggccgaggtggagggcgtctccggtacctggaagcggctcaccgagaacgtcaacgaactggcgggcaacctgacccgccaggtcagggccatcgccgaggtggccagtgccgtcgccgagggcgacctcacccgctcgatcaccgtcgacgcctccggggaggtggccgaactcaaggacaacatcaactcgatggtcggctccctgcgcgagaccacccgggccaaccaggagcaggactggctgaagtccaacctggcgcgcatctcgggcctcatgcaggggcaccgtgacctcgcggtcgtggccgagctcatcatggaggagctgacgccgctggtctccgcccagtacggcgccttctatctcgcggaggagaccggccggggcacccagctgcgactgatcggctcctacggctatcccgacgacacacagcgtcccgaccgcatcccgctcgggcgctccctggtcggccaggccgcgcgcaatcggcgtcccatcaccgtcgacgacctgccgcccgcctatgtgaccatctcctccggtctcgggcagatctcgccgaccgcgctgaaggtcctgcccatcgtggtcgacgaacaggtactgggcgtcatcgaactggcctcggtcacccgcttcacccagatccacgaggacttcctgggacagttgatggagaccatcggggtcaacgtcaacaccatcgtcgccaatggccgtacggacgagctgctcggcgagtcccagcggctgacggccgaacttcagtccaggtccgaggagttgcaggtacagcaggacgaactgcagcgctccaacgccgagctggaggagaaggccacgctgctggccactcagaaccgcgacatcgaggcgaagaacctgcagatcgaacaggcccgccaggagctggaggcacgggcacagcagctgtcgctcgcctcgaagtacaagtcggagttcctggccaacatgagccacgaactgcgtactcccctcaacagcctgctgatcctcgcccagttgctggcacagaacccgtcccacaacctcactccgaagcaggtcgagtacgcggggatcatccactcggcgggttccgacctgctgcagctgatcaacgacatcctcgacctgtcgaaggtcgaggccggcaagatggacatctctcccgaacgcgtcgccctgcgccgtctgctcgactatgtagaagcgacgttccggccgatgacgagccagaagagcctcgaattcaccatgagcaccgccccgggcgtccccgtggacctgctcaccgacgattcccggctgcggcaggtgctgcgcaatctgctctcgaacgccgtcaagttcaccgaacgcggcggcgtcggactgcacatcgagccggccgtcgaccagaacatccctgccgccgtccaccgcggtggcgccgtcgtggccttccacgtcaaggacaccggaatcggcattcccgagcagcagttggagacgatcttcggagcgttccagcaggcggacgggaccacgagccgcaagtacggcggaaccggactcggactgtccatcacccgcgagatcgcccatctgctcggtggtgcggtcaccgtggacagcacacccggacagggcagcacgttcactctctatctgccggtcgcccgcgccgacttcgaggagctcgcccagggagcccagcccggtgaggcgagccagggggacggtgcggccgaccacccccgggggtcccaagccctcaccggtgccggcgggcccacgcaccgcaggcgccggatcctggtcgtcgaggagcggccccggggtctgctgaccctcgtcgcggagagcaccgtggccaacctgacgagaggacaccacggcggcgatccgcgtgaagtcatcgacgtcaccaccacggtggacgcccaggaggcggccggcgccctggcggcggaaccgtgccactgcgtggtcctcgaactcggcatgtcgggcggtgaggcctcacggttcctcgacgccctggacggggaccccgcgctggcctccgtacccgtcctggtccacaacggacaacgcgccgacgtgacgctggatccggcactgcggtcccgttccgcggcccgctcgctggagatcttctccagcctcgacgagctgcgggaacggatcgccctgcatctgtcggccgaggaacccggggacgtgctgcccctcgtccgcccggagaagccccagccggagcagacgctggtggtggacggcaccttcaccggccggaccgtcctcgtcgtcgacgacgacgcccgcaacctcttcgcgctcagcgggatcctggaactccacggattcaaggtgctgcacgcggagaacggcaggaagggcgtcgacaccctgctcgctcatcccgagatctgcctggtgctgatggacgtgatgatgcccgagatggacggctacgcggcgaccacggaaatccggagcatgtcccagtacaccgaccttccggtcgtcgccgtcaccgcgaaggcgatgcccggcgaccgggagaaggccctgcagtccggagccagtgactacgtcaccaagccggtcgacgcgaacgacctcatcgcctgcgtccgacgctggctgtccgcctgaagcagcacggcctccggaccacccgcacctccggaggccgtgcgtcttccccagcccggcgtgttctgcctgccagccgaggagcaccagcacagtgaccactccccaccagcccggtgaacccgcccggggcgaggagccgttcggctcccccactcgcccgccggcctttgtcgagttgccccaccagagcacgtcaccttccgagccgagcgcaacggcggacggggtggcgagtgccgaggcgcagtccgtcgccggccggctcgcgacgaccgtcgagcggctgcggcgcgaggtctgggcggcccaggccgccgcggacggacgcgctctcctcgaactcgcgaagggaatcctgatcgagcgcctcggcttcggtccgacggaggccgcccggcatctgacggccctggccgagcgggccggcgtgccaccgctcgaactcgcggtcgacgtcatcaatcaggcggcccgcgaccggctctcggagatcgccacggagctcgtcgccgactcggccgctcttcccgagcgtgccgacgcccgggaccgttcgtccacggccgtccggttgcgtgcggcagagagcggcgccctggcggcggacgacgcgcagtccgtcgccgactccctgctccagcacgcgctggctccgctcggcgcgagcgccgtggccgtatgggcggcacgggccgacggctccctcacgctcgcgggcagcgcgggattctccagggccgagtccgcccgctggtgctacatcccgccgggcgtggcgaccgtcgccaggcaggcgctcaccgagcgcggtacgcagtggttcccctcgctgaccgaggcggatgttccgtccatcggccgcagtgaattcccggacggcggcagggtcgccgtccccgccggcaccggcggtcgtatccacggtgtgctggagatcagctggcccgctcccctggcaccgcagcccccgcagatcgtgcggcaggtcgaagccctggccgagctgtgcgcccacaccctcgagacgcagaccccgttggccggtccctccccggtcggagagccgcgcgccctggcggcctcctcggaactggtgcacctggccgaaggactgcacgatccggctctggtcctcgtaccgcacgccgatgacaacgggtacctggtcgacttccgcatcgactacgtcaacgggcgtttcctcgacccggcgggacgcccgcgcagcgccgtgaacggtgcgctgttcctggaggcctatcccatggccgccggggacagcgaactcttcgagcagatcgagcgggtgtacgccaccggggagccgttccgcgcccagcggatgacgctcacggcgctggtggagcaggtaccgctgtccgccgtcgccgacattcacgtcagtcggcacggcagcagcctcatcctcatctggcgcctcgagaacgaggccgcacgccttgccagcctcctgcagaacgcccagcggctgggacgtatcggcggcttcgaggagaacctgctcaccgacgagatcacctggaacagccagttgtacgcgctcttcgggcggcccacgtacagctctccggtgcctgtgcaggagctggcggcccatgcccatccggacgacaccgtggccatcggccgattcctgcggaccatagtgcaccaccgccgccccgcctcggcggccttccggctccagcgcccggacggcgtgacccggcacatgcgggtggtggcggagcctgtcctggacgcggacaagcggctgctcgccgtccgcggcgcctaccaggacatctccgcacagcactggaccgaggtggccctcgccgtcacccgcgaccagctcgcgcacaccgagcagcaggccgccgagcgcaatcggctggctctccagctgcagcacgccatcatgcccccgacccaggcgccgctggagatcccacagctccagctcgcggtccggtaccggcccgccgagaccgatcaactggtcggaggcgactggtacgacgccgtcgtcctgccctccaagctggtgctcctgtgcgtcggcgacgtcgccggccacggaatcgaggccgcgacgagcatggtcgtcctgcgcaacgcgctgcgtggcctcgcggtgaccggcgcagggccggcccaactgctgtcctggctcaacatcgtcgcccaccatctgaccggagcggtgacggccacggccgtgtgcggtctgtacgatccgtcccgccgcgtcctgcgctgggcgcgggcgggtcacctcccgcccgtcgtggtccgcggcccggaggccaccccgctgcctctcgtacgagggatgctgctcggtgcggtggcggaggccacgtacgaggaggaggaagtgtccctggagcccggcgacaccctgctgatgtacaccgacggcctgatcgagcggcgcgacgtgtccgtggaagaggcgctggcccagctgctcatcaccgcccgggcacagacgccgagcctgtcccatcagctggaccggctgctcacctacagcaggtcggacacggacgacgacacatgcatcgtgggcatccgcgtgtcgtgacccgtcggcgcgcaccggtccgaggtgccctcctgggcgcgtccggcctggccgtgtgtttgtggcgtgaagatcgagaagaggggtacacggggctggcccccgtccgtttcccgagtcaaaaagggtggatcgaatgacagccgtggccgcacccgccgcgacccgcaccactgggcagcacccgaccgcaccggcacacgaggtcgaactcgacgccatcgccgacccgttggcggtgagcccgaaggacgcgcgcgagctctctcgccacttcttcgcccgcctgtccgtgctcgaggagggcactcaggactaccagtacgtgcgcaacaccctcatagagatgaacctgacgctcgtcaggtacgcggcctcgcgcttccgcagccgaggctccggtgagatggaagacatcgttcaggtcggaacgatcggcctgatcaaggccatcgaccggttcgagctgtcgcgggaggtcgagttcgcgtccttcgccgtcccctacatcgtgggcgagatcaagcgcttcttccgggacaccagctgggccgtccatgtgccgcggcgcctccaggaggcacgggtggagctggcccaggccaccgacgaactcagccggcgcaccggccgcactccgacggtacgggaactggcggagctcatgtccctgaccgaggaggaggtcatcgaggcgcgcaaggcggcgaacgcctaccggagctcctccctggacgcgtccctctccggcgacgggtccgccgacaacgagtcggtcctcgccgacttcatcgggcgggaggaaacggcgctggagctgatcgaggacatgcactccctcgcgcccctcgtcgctcagctcgacgaacgtgaccggcggatcctgcatctgcggttcgtcgacgaactcacccaggcgcagatcggggaacggctgggcatctcccagatgcacgtctcacgcctgatcaacaagatcatcaccacgctgcgtgcgggactgctcagcgagtgcacgggctgaccccgagcacggccgtggggccgcggtccggtggaccgcggccccactgcgttgcccgggtcgtcagtgcttgaagacgtccttcgtcttctccttcgcctggcgggcgtcacccttcgacttctccgcctgtccctcggcggccatccgctcgttgcccacggcacggccggccgccgccttggccttgcccttggcctgttccatctttgccttggccttctgatcgccagccacagatcttcactccaagccgccatcgacaatgcgttgtcgcttcaacgagtgaccccctgcgccacatccaaacccggcattcgccgccatttccgggcgttctccctaatggccgtcgagctgatcgcggtgcgcgggatcaccgaggtgcttgccctcgtcgaactcgggcgatcccttgatctcggccttggtccgcgccaccacgatcttcttctcctcgtggtcgacgccggtgatgccggcggccggcagcatcaccttcctgccgaagatccacactccggtgtcgacgagaacgtactgggagtcgaccagacgggactgtttgtcgaccttgccgacgcgcccgtcggcggcctcgacccggtatcccgccagatccgcgtccggagtgtggccggcggtcggaacgaaggacgagatgttgtcactcacgcgtactcctcgggttggtttctcatcgggcgtgcaccggaccggctgaccggtccgaagccgggtagacggacgaggaaaacgtccgttccgacatcctcaggagacaagacatgcccggaatcgtggaccggatcaagcagttcgccaggagcccccagggccggcgcaccgtcgccgaggcgcgccgtgccgcggccgatccccgtcgacgcgctcaggctcagcgcctgctggggaagttccgcggacggcgctgacctctccgtcgggcaggtttcctgtcagcgtctgcggctccggctcgcccagccggagccgatgcccgcgacatggagggacagcagggccagcccgatcagcatgaaattggtggaggtgaagacgtcgttcgtcgcgatgtcggccgcattgatgaggaaggcgatgaagaacagtactgctgcaacgatgccgagcatggcatctcctctcgtcggtggcacccgtatgcccccgacaggagggagtacgcggtgcaccgcgaagcagccggtgacttccgccgacacgtgtggcgggccgtttggcgggtaatcgggccgtgctcgctgcgggtcggcgcccagtaccgcgagaggttgatcacgcgggccgggcgtcccgccgggcatcggcgcctgacctcagggtaggcgagccatgtcagccagtgcttgatggaggaaattgtgtcgacggaacaagcccccctgtccattgatgtgacgctcccccgggaggacgtcgcacttgtcaccgtcaaggggttcttggacgtcgacacggggaccgagctccaccaccatctcgccaaccagatgcatcacggtcggcgacatctgctgctggacctctccgcggttcccttcatggattcgtccggcatcaacatcatcctcaaggcctacaaggagacgcgccgcgtcgagggcagcgtgcgcctcatcgatcccgctccggcggtgcagcggatcctcgacctcaccggcgtgagtctgacggttccgtccgccaagagcctcgacgaagccctcgccgagacgggcgatgcgacggaccggcagtagcgggggccgcccccggccggcgcgcgggttccacctgacccaccccggccacccggtccgcccggtgagcgggccgcgtcggggacaatagttgccgtttgacaactgtagtcgtgaggcaacaaagtgtgaggcgtctcaggcgcgggaggatccgagatgtggcgggcgacagcggccgaccgtaccgagcgaccaaggcatgagcgccgcgcctcgacgcgcaccgccggccggggcggtcctcacgccgtgcgggcgtccgctccctcgtgctcctggatctgcgccgccgcggtggcgcagaaggcttcgagcccttgcaggagtgccgttcgcttggcggcgggcatccgtgccagcacggactccagggcactctcgcggcgtgaccgcacctcggccaggaacgagctgccccgatggctcagatacaggcacagctcacggcggctggtcgcgctcaccgcgcgctccacgaaccccaccgcctggagccggtcgcagagtctgctggtcgacggcgggctggagccgagtgcgtcggcaagggtgcgcagattgatgccctcgttgtgctcgagaatgaagagcacacgcagctgggaggcggaaacaggcgctgtcgaggcgcgcccccacaggatttccagcagttcggccgcctctgaggtcacacgcgccacctcagtggggtgcgggcgcgtgctggaggacgtcaccgtctcactctcccagggtgctcgggggctgtcagctcgccggggcgacagctcgcaaccaaccatagacaccggcaccggcgcatgggcgatggcctcccctggaacgtgggtgcgaaatcgtactagtcgaagaatggcgtatccgacatcgtgaacagattcgtggcagtcgaacgggctctgcgcaccgcggctccccaccagttgctggacgcgctccgcgaggtgctgcgcaaccggtacgcggccgagtccgtcgagttcctcctggccgactacggggtcacggtcctgcagcccctctcccccgaggtctccgccactggccccgtcccgctgcacgacagccgggccggccgggccttcggtgcccaggagcccttcctggaggagccggccgacggcctggcccgcgtgcatctgccggtgacggtacggggcgaccggctcggcgtcctcaccgtcacgctgccctccgaggacgtgaaggactcgctgcccgagctccgcgagatcgccgaggtcctgggccacgcggtgatcgtggccgagcgggacaccgacgtgtacgtacaggcacggcgcaaggaccggctcacgctggcggccgagatgcagtggcagctgctccccggccgttcctgctcccggccggagtacgcgctcggtgcccagctcgagcccgcgtacgcgatcttcggtgacaacttcgactggtccgccgaccccgaccgcctgatgctctacatcaccaacggcatgggcgagggcatcgaggcctccctgctgaccagtctgggcatcaacgcgctgcgcaacgcacggcgggcggggatccccatcgaggatcaggcggccctcgccgatcaagccgtctacgcccagtaccgcggcacgtcatatctggccgtgctcctggtcgagttcgagctgtccaccggccgcatgaaggtggtcgacgcgggctcgccccgcatgctgcggctgcgcggcagaagcgtcgaagcggtggatttcgaggcccagttgccgctgggcatgttcgaggagaccgactacgtcgcgcaggagttccacgtcgaaccgggtgaccgtctcgtcttcgtgagcgacggtgtgcacggcgtcgccgcgccggggggtgagacgtacggggagaaggcgttgaccagggccatcaccgccacgaggctgctttcggcggcggaggtgccccacgcggtcctcagagagctgtccggccaccgcggcggcccgtcgcccgcggacgacgcactcgtcgtatgcctggactggtacggccgccgaggggcctccccggctcccgaaggtgattgacccgaactcgtcatccaaagtggcatgcgcgggacgcggttgggcaggtttccgcgtcgtcggacgatctccggggtatcggttgtcgctcacgatccggccatgactacagttgccgtgcgacaagaaaccgcctttccccggcgagccccacagccaggaaaccttacatacgaaggagacacatacgtgacggatcaggagccggtggcacaccacgaggcgccgacacaggcgctcggggactttctgcgacgccgccgcgagcagatcgcccagcgctgggccgacgaggcactgttccgcacggtcttcacggtgtcccgcgacgaggccgtggaagcggccggggccgtggtggaggcactcgccgcggtggcgttctcggagcggatcgagaacctgggagccaccggcttcgccgccgtgcgggaacagctcggacgcatggcggccgcgcgctcccgggcaggcgcctcggccgaccagatcgccgacgacgtgtcggcgctgcgcccctcgatcacggaactcctgaacgccgacctgtccgaggcgccggacgaggacgcccgcgagctgctgatcactctcaccgtcctcctgggcaccctgcgactcgtcgtcctggagacggtgctgaccgccggcgaggaactcatcgaacggcagcgtctccaactgctcgaagtggccacgcccgtcatcaaactgtggaccggcatcgtcgccgtgcccctcatcggcaccctcgacagcgcccgcagccaggtggtgatggagagcctcctggacgccgtcgtcgcgcagcaggcccggttcgccattctggacatcaccggcgtaccgaccgtcgactccttggtggcacagcacctgatgaagacggtggcagcggcgcgcctcatgggggccgagtgcatcgtctcgggcatccggccggcgatcgcgcagaccatcgtgcacctcgggatcgacctgggcaccgttgtgacccgtgcgagcctcgcggacgcactcggttacgccctgcaccggcagggcgccgtgatcgtcgatcaggcgtcggccggtgggatccagcagtgatcggcgaccccctcggccgaccaggcatccatgtacccgtactcaaactcggcaatgtccttctcgtcaccctccagggcgacctgcacgaccacgccgcggaacagttgcagcaggacatcggcgaggccgtcgcgagcagcgccgtgacgggcgtcgtcatcgacgtctccggcgtggagatcgtcgactccttcctcggcagggtgttcgcggagatcgccgcgaccgcccggctgctggccgcgcagaccatcgtggccggtatgcggcccgcggtcgccatcaccctggtcgagctgggcctgaccctgcccggactgcggacggcgctcgacgccgagcaggccatgcggctgctgaccgggacaccaccgcacctgccgcacgttccaggccgccgggagagcgcgtgacggagacttcgggccgcgtcgccgcctgcctgccgatccgctcggacatggatctcgcatgggtgcggcagcatgtgcggcaggcggccgccgagctcggtttcggcctggtggatcagaccaaactggtcaccgcggccagcgagctcgcccgcaacacactcatccacggcggaggggggcaggtccagtgcactcccctcgagatcggccggtcccgggggcttcgcctcaccttcagcgacgaaggaccgggaatcgccgacatcgagcaggcgctgggcgacggctacacctcgggcggcgggctcgggctggggctcggcggtgcccggcggctggtgcacgagttctccatcgacagccgtccgggagaggggacttcggtcaccgtcatctgctggtccgcgggtgcgccgcacacgcgagaggagacgcgatgacacgcgtccgagaagtgcccgtgcacgactcgacccgcgtccgggacgtccgggtggccgccgaggctacggcccggcaggcggggctcgatgaggaccgcaccgccgcagccgcgctcgtggccaccgaactcgccaccaacctgctcaagcacgcgggcggcggccggatactgatcgactccgtggacgcgtacctcgggcccccgacggcgtcacccgaccctgtcgtacagatcgtggccatcgaccacggccccgggatcaccgatctgcccgccgcgctgggagacggcttctccaccgcctcgtcgctgggcgcgggactgggcacatgccggcgggtcgccgacgcgttcgacctgcacagctcgccgggccggggcaccgtcgccctggcccggatccatggcgcggccaagagccgggccgaacgccacgagcggcgcgccgacgctccggtccgggccggcgggatcaacatccctctcgcgggcgccgatgtgtcgggcgacgcctgggcctgcgtacgcgccgccgatcgcgtcactctgctcctggccgacggcctgggccacggccccggtgcggcccacgcctcggacgctgccgtggagcagctgcaccgctccgcacacctgtctccgccggagctgctcgcgcagctgcacaccgccctccgtgacacccggggtgccgccgtcgcggtcgcccaactcgacctggccgccgggagtctgtccttctccggcatcgggaacgtcggcgcccggctgcgctccggcgacagctggaagccgctcctgtcccaccccgggatcgtcggcgcacaccgtccggcgcggatgccccatcaccgggtgccgtggacggacgacagcctcctcgttctgcacagtgacggcctgcccagccggtggacccctccgcccgccgtcccgctcggcgccctggaccccgcggtgacggccgccgcgatcgtccgcgacgccagcagttccgcccggcccgtacgcgacgacaccgcggtggcggtgctgtcctccacgccaccggacccacgaccatgacccacacctggtacatcagcaccgtcaccgacgcggccggtgcccggatcgccgtcgcgcgcctcgcggccgcccacggcgtccccgtcctcgaccgcacccgcctggtcaccgcgctgaccgcgcagctgcggcagtgcctcaccaagggcggcgcctggcgactcgtcctggagaccgtcgccccggcggccggccaggagcacggccggctcgacgtcaccctgtgtccgggccgggacggcaccgcagccgagcggccggcctggcacgcggccgtcgacttcaccgaaccgggcgacctcgacgcggtcgcccgggtggcggccgaccccgcgaccctggccgacgcgctcttcggcgcggacgaagacaccgcacgggtcatggagaagctcaccgaacaggaagcgctggtcgccttccaccgtgaggagctgcaccagacgaaccagggcgtcctcgccctgcacgccgaactcgacgcggccggcgaggcccagcgcgaacttttcgccgccgaacgggaggcgcgtcaggaggcggagaaggcgcgccacaggctgacctttctggccgacgccagcgcggccctgacctcctctctcaaccatgaggagatcctgcgccggctcccggaactcctgaccccggcctatgccgagagcgtcgatgtgtggctgttcgcggacgaggacaagcagcgacagagtccccgccccgcggcggccgtcaccgccgcgcgtaccggccgcccccagtacgccgccgagcaccccggtggcctgcccggtgtggacgacgtacccccgtccgccctgcgccccgaccggcccctgctctgcatcccgctgcccattcgccgggcgcccctgggcgtgatgacgctcacgccaccgggcgagcggtgggacccggacgacgccgtgatgcttctcgaactggcccgcagagcgggcatcgcgatcgacaacgcgcagcgcttcgagcacagccgcgacatcgccgaaacactgcaacgcgccctgctgaccgacttgcccacgacgcccggactacacctggccgcccgctatcttccggccacgcacggactgaacatcggcggcgactggtacgacgccttccggcagccggacgggagtctgatcaccgtcatcggcgacgtcaccgggcacggtctgcacgccgccgtgatgatgagccagctgcgcaccgcgctgcgtgcctacgccgtcgacggaggcagcccgggccagctcctcacgcggctgcacctgttcctccaccatctgcagccggacctgtacgcgacggcggtcatcgcccgtttccgccccgacgagccgacggtcacctgggccgccgccggtcatcccccaccggtgctgcgcctgcccgacgggcgcgtacgcacgctggacgccaagccgggcgcgatgctgggcatcccgctgggccaggacatcggcgaccacaccgtacggatgccgcccggctcgacgctcgccctgtacacagacgggctcgtcgagcggcgcgctcacgggatagacccgggtatcgggcgtctggccacggcgctctcggccctgcgcggcccggacctggacgaggacctggacgcctccgccgaccggatcctcgacccactgctgtgcgactcggagcgcgacgacgacatatgccttctgctctgtcacatcgacagcgagccggtgccggcgcttcactcctgagcgcgccggtgcctgtccccgcccgccccgggacgggcacgggcttcgtggaaggcgtgcagaccgtgctccagcgacgtccgctgcgccgggggcatggcggcgagcacggtcgcaaggctccgtgacctccgctccgcgacctccaggaggacccgccgtccgtgcggggtgacccgcaactgcagctcgcgccggttgcggggatgcgacatccgctccagcaggcccgcggcctcgagccggtcgcagagccggctggccgcgggcagtgcgatcccgagggtgtcggccagtgccgtgagattgagttccgaccggtgccacacggctcggagggctttcagctggtaggcggacaggcgcgggctgacggcctcggcggccgcggtccacagggtcacgaggttctccaccgcgtccgcgacctgccgggccaccgcctcggggcgacggcccgcatcagctgcgtcactcggctccctctcatcccgcacggttcatcacgtgctcccccggcccgtgcgcgggtccgtcggtccctggtcgaagccgcctcgaccaggcccgggcgtcgcccgcgtcccggcccccggccggggtccggcgagccacaggccacagcggtatgtcacacacagttctctttctccgggtggcgcctacacggttgtcctgatgcgcggcctacccgaggagccggatagtacgcaggctgcgagcagcttcttcatgggatcgccgcacaatacgcgggggctttgcatgtatcgcctccgtcgtttcgggaactcatcagccacagaggaaacccataggagaccgaacgccgatgcggatgcgtggtagtcagcggccgggcagtggccgcacacggagatgtgaaagccgaggacagaatggaccacggtgatccgtcggcacgacagcccccggaggacaggcgagatgtcaaccaagccgcgtcgggaaagccccttgcccactgaagacgtcaggagcctcaccgccgccttcgacggcgacctgcggaacgtgaccgacgcccggctcgccgcggaaggctttctgcggactctggcgcgggcttcacccccgacgagccccgagtgcgagcacgatgtcctgctggtggtgaacgagttggccgccaacgccgtccagtacgcgcccggccccttcacactgcgtatgcgcacgaccttcgacggggtccatgtcacgctgcgggacaccagcacgacacgaccggcgccgcgccccttccatcccagccggggcggtggcggaatcggctggcacctcgtgcagtcgctgtgcacgcaggtgagcgtggtcgtgcatcccgaggggaaggacatccacgtcttcctgccctggtgaggcgggccggcggccgggattcccggccccgtttccgccatcgcccgggaaagtcccacggaagttcgtccccccgtcgacgcactcatgtcctcgcgaatgcgggtgggttggggcggctcccaccgcggggacgactcactcggtccggtctcgaggaagctctcggtaatacgcgccgacgctgcccaggtactccgggtccagcgtctcgctgtcggtgcggaagagcggagccgctttcacttcctccttcgtgcacgccagagtgatctgccgcgcctgggtgtcgatgcccgtgatcacgcccacggggatcagaacgctcttgccgaacacccacaccccggtgtcgacgaccaggtgccgcatgcccacgtcatcggcctgccggtccacctgcccgatcgtcccgtcggtcgcctcgactgtgaaccctgtcaggtcctgtccctccatgtggccggttgccggctcgtagaaccacggtccgtcgatgctcacgccgtttccttccctgccgaggagccgtgccgcgaggccgggcgagcgtgcggtgcgcgccggccaccgctcacctccgcgcgggcggagagggcggcctcgccacgacaggactccgttgcgaacgtcctgcacatatcccggatcgccgtccgcacaccctccgtcgcgcgatcggtgcgtccgcccgctcagcccgtgccgggccgctgttcgtcggcttcaccggcgtcgtcggcgacgcacggcgcggtgaggtggtcgagcgtgcccgtgatctccaggaggcgctccaggcaggcagggcgctcgtccaggtacaggctgacgcccgccgcgtccgtacgacgacggaccatgaggagggcggacaggcccatggagtcgacggagctcagttccgcgaagtccagccgcagggcggacagcggcgggccggtctcgcgccgctcggcgagcaacagttccgtggcgcgcacgaatgcgtggcacgactcgtagtccaggtcaccggcgacgcgcaccacggccaccgtggagtccgcgtcggccgtagtggtgaagtacggggaggaagaggtggtcatacgggctttccggggccggggatcttcagtgctgccgagcgggtccgcagggcgccgagcgcccggccgaggatacgccgggccccgggggaagtcctcgagcagccccgtgaagatggccagagccgggcgcagggagccggcggggacaccccgggcggtgaggatgtccgctcccgggcgacggtgaggcggactgcggcgcgcgttccggcccgctccggcccgaccctggtctgcacgggagcgatcaggtcgagcagcaccatctcgacgtcggcaccgccgcgcaggcggcgcggaccacggcggagacggcggattcgtcgcccgcgtacaccgccgacgacaactggtcgcggttctcctccggttcggcggcgtcgagggcgggagcgggaagcgcgggagcggcggtcatgccagatgattcgggcggcgctgagcggggcaacgtcgagcggccactgccgtgcgaccgccggctaccaggaagcggactcgccgcgggccggctgcgggagctcgatctccgcggtgacctgtttgccgggcgaaccgggctgcacgatgacggaccggctgaccgcgcgcacgatctccagcccgtgcccgccgatccggcacgcgtcccgcggccggggagtcggcatcttgctcgacgtgtcccagacggccacgcgtaccgcacggccgtccgcggacagctccacctgcaacccacaggggcctggggcgtgccgtatcgcgttggtgaccagttcactgacgaccagctggatgtcaccgacgagtcggtccggcaagggggtgccatcggcctcttggacctcggacaggaaattcgacgacgcggtgcgcccctccactgcggtcgcggtgccgccttcccacgtgacgcggcaacgtggcgtggcatgcctgcccggagcctgttctttcgatacttgctgccagagcgagatgaccatggggtgattcgccttacacggtaggttttgctgccttctaggtagatcgttacctcttccgcctaccctcggcaccccggagtatggccactcatccctcgggtcactcgtccgccgcgtagccggacagccgtataagccgtggtcacgaatcatgttcgaaatatcgaacactcgctgccggacgggtgagccgtctacttgtcgattcacgacacaacccgcgccgacgtgagctacattcgagcaccgtcgatctctggggagggcgacatcgcaaggagaaatcgggggcggccgtcatgcacaacttcgggctccctccgtcggccacgccggtcatgacgggagggctcgccgacagcgtcttcgagacggcgctcggcaatcccggactgccgcagatcgcccggcgctcccacgactccccgggcacctggacccaggtgagcgcggcccagttgcgcgacgaggtcgtcgacctggccaggggactcatcgcgtccgggatccgcccgggcaaccgagtggccatcatgtcgcgcacccgttacgagtggaccgtgctcagctgcgcgctgtggtcactgggcgccgagatcgtgcccctctatccgaactcgtcgcacgaacaggtcgcctggatcctcaaggacgccgactgcgtcggggtgctcgtcgaggacgaacagggcgtcatgacggtcgggtcggtgtgcgcggggctgccccggctgcgacacgtctggcagctggactccggctccctggacgaactggtcgagcggggccggccggtgccggccgcgacggtcgactcgctgcgccggatcgtgctgcccgactccaccgccgtcatcgcctacacctccggtacgagcggacaccccagggggtgcgcgctgagccatcgcagtctggccagcacctgcgacacgctgctggacggatggcggcacaccgcggcctcgcccggcgagcagccggccgtcctcgccttcctccccttctcccatgtgtacggcctcatggtccagggcctgtgcctgcggggcggcctgctgatggggcacgagcccgatctgcgcgcggagtccctggccgccgcgttccggtccttccgccccacctatctgtacgccgtgccctccgtcttcgagaagatctacaagagcttcctcacggcggccgagcgcacgggccggggcacgttgttcgagcgggccgcgcggacggcccaggactacgccgaagccgccgaacagcagcggctggggacggggccggggccgggcttcgacctgaagctccaacacgccttgtacgaaagggctgtgtaccgcaaactccgcgactcgctgggcggcaggatctgcggagccgtctcgggcggctcacccctcaaccgcgaactcaccctcttctacgcgggaatcgggatcatggtccacgacggctacggcctgaccgagaccagcgggggcatcaccgcccagcccgtgggccgggagaagttcggaaccgtggggcggcctctgcccggcacggacatccaggtcgccgaggacggcgagatcctggtccgcgggccatcggtgttccagggctacgtcaacgacatcccgggcacccgggcgtccctgcgcgacggctggctcgcgaccggcgacctcggccgcctcgactccgagggctatctgtcgatcacgggccgtaagaaggacaccatcgtcacgagcagcggcaagagcgtcgcgccgtcggtcctcgaagagcgacttcgggtgcatccgctgatccaccaggccgtgatcgtcggcgagaaccggccctgtgtgggcgccttgatcaccctggaccccgactatctgccgcactggcgcacgatggtggccgcccaggccgacgcgccgagccgggaggcacgcgagcagaacgcggtgctgcaggaggtcacgcgggccgtcgccgcggccaacagcttcgtctcgcgctccgaatccatccgcgtcttccgcatcctcccggagcccttcgacccagccaacggattgctcacgccctccatgaagctgcgcagggacgtgatcgtgcgccggtacgccaccgagatcgacgccatgtaccagtcgtcggcgcggacgagagtgaagtccctctcggacgaacccgtgagctgggaagagcacgaagagaacgaggacgacgtgttccggcgggtccggtagcggcacggcacgcatacgtggccgccgcccccctccttcccgggtcggggagcggcggccacgggccgggtccgtcagtggccgggccagccgtccaggtggcgatggacggtgacggtgggccgctcgtcccccttgggcgcgcccgccaccgcgtcgtgcagcacggtgttcacctcgccggccagcgcgtcggcccgcgccttgacctcggtggccgggagcgtcgaacgggtcaggtcgtccagtcgccggtggatgtcggcgagctgtcgctgggcctgcgcgtccaggctgaaggggcgcggggtggagacgacgaactggtaggcgccggccagggtctggcagccgtcgcagtgcttgttgacggcgtcgccccggttgaccgcgttgagatgggtctggtcgccggacatggtgacgatctggaaggacagggccaccgagcggcagcggtcgtcgaccgagcagcccacgccgacggcattcgcctggttgcggaccgtggcggcgttgaccgtgccgagctggcgcacggtgaaggagtccttggtctggctgtggtggcggaagtcggcgcggctgaacgtctggtcggcggcgaccgcggagtgctgtggcacccccgtggcggcctgcgcgggcacggcggtcgccatcccggcggcccccgcggcgaacaggcccacgcggacggcgcgttgactgaagacggagctggtacgaggctttcgatggtggttcacgtggatctcctgctggagtgacttcggcggacggatcgccgccgagcccggggtgcacggcacccgcgagtgggcggacgggaccggacggcgcgccccggaacgggggccggtccacggtgcccgggccggccgcgcgccgttcggcgcggcgccgcgcgtgctcggcccgggccgggatcaggaaatggccgggctgggcgactcgaccggcgacggactggaactgaccggggcggacggactgtcggccggggacgagacgggcgccgacggcgagccgggatcggcgggcacggtggccggcggctcaccgctcgcggccgggctgccggtcggcttcccgacggtctcctcggacgcggtccccgacgcgctgggccgcgggctcctggagtccgacgggctcgccgaggcggacgggtctgccgaaccgcccggcgtggccgcgccggccggagccgtggtggacgccgcggacgggggtgttgtcgtccgggccgggtgtggtcgcgtgccgggccggtggtgcggaggtggacacgccgggctggaggatcggcgcgatcgggggccgcttcggcagcggttcgggagtcataccggacacccaggcgtaggcgagcccggacagggcggccaggctcagggcgcacagggcgacgcgcagccggggccgcccggccgtggacttcacggcgccccgccacaggcgtccgccgagtttcacggacagatagaccacgccggccatcgggcacagcagcatcacgcagccgacgacgccgaccagcccggcggcgatctcgccgtgggcgaaggcgccgccggtaccgagcagttgctcggtcagcgagcgggtcatcgtggcaacgatccggggcaggttccacagcgcgtagccgagttcgccgagcagcagcggaaccatggtcagcacccaggtggcgacgatggtccgggccgaacgcttgagtgccgcgacctccttgcgggccttgcggccggtcctgccgggtaccaggctgaggaggatcggcttgatcttcccgtagagatcggggactccggcgagatcgccgaggatgtagtagccgtcgagccgtacggcaggcatcagctgttcgaggatctcgaagtgccccaggtacacggcggccagaaagaaggcctggccgctgagggcgtaggcgccggccatggccagcatgaagacgacgttgaagtagaccccgcccaggtcggtgcgcagtcggccgacccgcccgatccggtagacgtcggtgacgtccgtgtacatggaaggccagatcaggaagaggccgcagccgatgcacccggggcgggcgccgccgtagcggcaggccgaggcgtgaccgaactcgtggaacaccagggaggccacggtcagcacgaagacgaccagcagcaggaccggctggtccagcacctccagcacgggcgtgatcgcgccgaagaacgcgaacagccagacgtccaggacggcgatccccgccaggacggccagaacgaccaccgggcggtgcagccacgccagggcgccggcgatcgtggccacccggcgttcgttgaagatgacccggtggcccttgagcgccagcagcaggtcggaccggggcgcggatatgtcttcctcctcccgcccctcggggaccgtcacgcccagcgggtccagcttctgctcgatcagatagcggacgttgtccgcactgacctcacgcccgaaacggccgctcacccggtgggcgatcgtctcgatgtcgcggctgccgtcgaccgacgacgcgaccagatgcagcagccgcgacagctgcaccacctgcccgtccccccggcgggcgatgtacttgggctcggtgaagcccgatccctggtactcgccgtgcagcttgaggcccgcgctcagccgcggcaccaccggcctctccaggccggccacgggcaggccgcccgtcgcgacctgctcgtacgtcaccgccatgccccccggccccggaaccggcgtcccggtgtcgtacggcgatgcggtcttgtcccccagcagcgtcatgtgcgcttccctccccccgatgcggaccgcgcctgcccttgccccgcgcggtccgccgaacgtgccctcgtcgtacgggagttactgagtgatgttgatcgactgggcggcctgcgactgagccaccgaccacgacgagtggtcattgagcgcggccgactcgttgtgcgcggagacgttggcgacgtgcttggtgacgttcaccgtcttgccgaagctgaacttcagccgtcccagggcctcacggcccggcagcagctccgcggactcggcttccagctcactggcgtccatgctcatggcgtgtcctttcacattgaccatcgttgacagaggcggtcgggcgcgcgggtggcgggcccgacagctgattgcggtagaggcagccgggagagtgacacatcgtcagaccgatgcgagcgaactcgggactgcccgggaggtggggcaccaccgcggcggggcggaggtgtggtgatgcgtcgccgcggtggtgccgggtgccgtacgatcccaggaccctggagccgtacggcaccggatcagtgggcgatgttgatggactgggcggcgcccgagtccgccaccgaccacgacgagtggttgttgagcgcggccgactcgttgtgcgcggagacgttggcgacgtgcttggtgacgttcaccgtcttgccgaagctgaacttcagccggccgagcgcctcacggcccggcagcagctccgcggactcggcttccagctcacgaggatccatcatgatcaattccccctcaggaatcgagaagtgttcccgtcggacacggtcaggtccccccggatcatgtccaactccgtcggacgtgctgtccaacgagattggacactaggggccgggtcagccgtgacgcaagcggttcggggcaactccttccgagagtcacccgacacgcccctagaatgatccgacgcggaagagttccgcccggcggcgagcaggaagtgaccatcggtggccaacgcactgcagcagatcatccgtgacaggctggacagcgagcgctggtcctacggcgaggtcgcccgccgcggcaacatcccgcgttccaccgtccatcacctggccaccaccgaccacatggcgcggatgccccagccggccaccctcgaaggcctcgcgctgggcctcgggctgcccctgggggccatccgccaggccgccgcggaggcctgtggcatccacctctacgccgccggagccgagcccccgagagcggccggcggcacctccgccgaccctgacgtggaggtgctcatcgccagcctccagcggctctcgtccgacgaccgccgccatgtcgccgccctcgtcgagtcactgctcaaccgcgcccccggcacgtcctgacacccgcacccgtccgcacacgacgccccgccgtgccccgagccccgcagccgcgggcggaaggtgtcgcgggcgcgcgcccccggcggaccagcacggcagcacccggactcaccgcctcccctcctaccactcccccaaaaagaagtcactcccgcccatacaggcatgatccgcagctagtctctcctcctgcctggggcccgtgagccgcacgccccgggtcatctggggggaacaattgctcttcgtacacggcggccccaccaccgccatcgtcaaaggaccgacgggagagtccgtcgtcctgctctccggcgagttgcccgcaaatctcacggacgcgtccataggcgaactgctcgacctcgccgcggccgtgctcaccgagggagaactcgccctcttcgaacagtgcctgaccacgctccgccgcggcgagggccccactccccagcgcatcgaggtcaacggcgccgtcatgacggtctaccgggactgacacccgtcgcatccgacgagacgtgccgccttgcgtcgtacacaagtccagcggtcgacacgctggtcagaaccccctgcgcaggtgcacgatcatcatcgacccacctgctcgccaggcgtgtcgctcccgcttgccctccggaagaaagtcggcgatggcaacgaccgcgaccccacgcacgcccgctaccgaccggaccgccccatgactgcggcccgcgtccccggcctgatcctgccgctcgcttttctctgcgtgctcgtgatcggagtcttctggtactggcgacatcgcggagactgacggctgcggcgcgatgttcagcagtagggcggttgattgcccagcgacgccgccacccgcatccatacgccgaagagccggtacagcgcggggagttcgccgtgtgcctccgctgttcggctgtccggggtggtgactcctgggatgcccagcagggtggaggcgacggatgccgactgccaacggacggtgagggtacgcgggttcgcgggcaccaagggtgcttccggtaccgcggagagagcggcggtgaccgcttcctcgatggcctggcgcgcctccgcggccgggcggagttccgcggcgaagcgatcatgtgcgtacttcacggggacggtggtgatcgagtcgtcccacgcggtggcctccgcgcaggcggcgtcgtctccggtgagtgccaccagcggcacgccgagcgtcgccgcggtggcctgggcgagcccgatctcgcccacgggccggccgtccagccacatgtcctcgatctcgtgccccatgaagctgtggctcagcacgccgagcgcaccggcccgcgcgtggtagccgacacagatcatggcgtcgtgttcgcgggtgaggccttcgagcatgcccatctgcttgggcctgccgcggatgaggcgggccgccgggtgcagggcctcgggcagcagattgcgcatggggccgtgcgcgtcattgacgacgatgtcggtggcaccggccgcgaccgcgccacggacggcggcgttgacgtcctcggccatcatcgagcgcccccgctcgtagtcccgcccgccgggctggacgtcgtcggcgccgacgagtccggtgatgccttccatgtccgcactgatgtggatccgcacgtcgcgcgctcctcaaggttgatcattcggagacgccgggcgcccggcgtgcggttccctcgggcgaacgccggccgcgatcagcgcgtgggctgtcgtacggagggcacagcggcgatgatgaccccggggagtccggacgtacgacaacggagaccgcatgacgacgggcagggacgcacgggtcgaagtgaagcccgtcgcgggacacatcggcgccgagatcaggggagtcgacctggcagggcccatggacgactcggtggtcgccgagatccgggcggcggtgctgcgctggaaggtggtgttcttccgggaacagcggctggatcacacctcccatgtcgcgttcgcgcggcggttcggcgagccggtctccctcaggtcgcgcggcagtgcgtcgcccccggacttccccgaggtcgagacgacggccgaccggctggaactgggtgagcggtacggcatggaccacgccgagtggctgcggcggcgccgccattcgctgctgcggggctggcactgcgaccacggtgcccggatcgacccgccggccgccaccgtcctgcgtgccgagaccgtgccgccctacggcggtgacacgacctggtccaatctggcggccgcctacgccggtctctcgaagccggtacgcgacttcgtcgacggcctgcgcgccgagcaccggctgggggtcgggtatcaggcgcggcccggcgacgacgcgtacgtacggcatctgctggaccatcagaccgcgtcggagcatccactcgtacgggtgcacccggagaccggcgagcgcgtgctgttcgtcaacggctactacgtggagcagatccaggacgtgtcccgtacggagagccgcgcgctcctcgacatgctgctgggcgaggcgacccggcccgagtacaccgtgcggttccgctgggagccggggagcgtcgccttctgggacaaccgggccaccatccatctggccccgagcgacacggcccacctcgaccacccccgggtcatgcaccgcgtgatgctcgccggtgacatcccggtcggtgtggacggcaaaccgtcggcaccgatcgccggcaccgagccggagcgctggtgaggctcagccgggtccctgttccgcttcttcgcgcaggaaattgctgacctggccgaccaggctctccacggcgccctcgcaccgtacgcccgactctgccgagcccacgggcagggacatgtcgcccgaccacaggtaccggccggtccactcgtcgtccgccttgaggtggatctggatgtccacccgggtcagcgaggtgtccgcgccggcggcgtacaggacagcggtggcgcggcgcagcgggtagaggtcgaacccctcgatgaactgcgagttgcgccagtcgaggaacgcgctcacgccgtcggggccggtgcggatgtcgagctggccgtcttcgaagtggatgtcgacgggttcgctcgcgcggttctcgacggtcacccggaagcggaagtaggtcagcccttcggcagcgtcgtcacggccccgcggaggctccgcttcctccaagccgtggacgcggacgcgcaggccggcgtactcgtcctcgtactcctgccagtcgccgatcacgttgggctcgcgcacggttcacctctccacttcagcggatgcttcctatccgcgcgcgcaacaaggtgtcaaatgaaccgaacatgtcgtggtcggtgaattcaccccgcttgatcagcgatcaagccgtgcgcagccacgatccccgccagggggtgaaggcggcgtttggggacgtgttgcacatcacgctcaccggtgccgctcgtcaccgcccgtgaaccacggggcgccgcccgccggaccggcggtggctggcagaattccgggcatggccccgatcacacccgcgcgtgccctgctgctgctcgtctgtgggctggtctgcctcctcaccgcctccggagctctcatcggcgcgctcttcggtggcgcgaaggccgccctcgtcgcggccgcctgcgcgggcgtggccggtctgctcgccacgctcctcgtgcgccggcgtgcgctggcccacttcgccgcggcgcagcgggaggccggggtccgcggatacgccgagggaatcgcgcacggcgtcctcctgcacgtgaccgcctacgaagccgccgtgtttccgcatacgggacccacgggggtgacacccgaggagcgtgccgcacgccgtaccgtcgcctaccggatggccgcgctggaggaggtgcccaggctcgtccgggaggccgccgccgacgcgctcgccgttctcgacgaggccgaccgcgcgcgtgccgaggaagcggtcgcgcaactcgcttccgtcgtacgccggcagtacgcccgcccctgatccgggcggtacgcccccggtattcgtccgggatttctcggcagccttgccgactccttccctttccttcgctattcgcgcgcttcatgcgtccggcgggtcgaacaattcgacccgccgaacgggattgcattcgactggccgaacgcctgtaatgccaggtcggcagcgcatcctgtgaatggcctcgaattgccgacaggctattgacgcaagggaattgcgcgccgcacactcgcgctcgatcgtgcaccccatgggacgggtcgtacggcgaaagacacggcgtgggccagattcgcccggatcgaggagagccgcaagtgaccgtagaagacagaggcataccgtccgacccgccggcgccgtcgcggcgcgggatactgcgggccctgctcgcgctgcccgccacggcgctcgtgtggggcgaaatgccgggggcggtgggttcggcggccgcggcggcgccgtcgaaggggtatgccacgcggtacaccatcgtgccgttcctcaacagcgacgacggcgtcgtgaacgtctatcagtccgacgacgccaccgacttccggctgctcaaggccaccgcgtacaccccgccgagcaaccggatccgcgacgccagtgtcttcaagcacaccaacggctactactacctcacctacaccacgcacacctggcaggacgtcagcaccaccatcgggttcgcgcgcagctccgaccgggtgaactggaccttcctgtacgaccacaccgtccccctcacgaacctgtcccgcgcgtgggcgcccgagtggttcgtcgacagcgacggcagcgtgaacgtcatcgtgtcctgctcggccaccgacaacgagtggatcttcaccccgtatctgctcaaggccaccaacaccgggctcacctcgtggtccgcgcccgtggccctgtccggcatcggcgccaaccacatcgacacgtacatcgtgaagatcggctccacctatcacgccttcaccaagaacgagacggccaagtacatcgagtacgccaccgccaccagcctcacgggcccgtacacgatcagcaggaccggcgactgggcgggctggggcagctatcgcgagggcccctcggtggtgcggctcgacaacggcgggtggcggatcttcttcgacggctacggcgacggcacctactacttcagcgacagctacgacaccttcgccacctggaccgcgccgaaggcactggccggcatctcgggcaccgcacgtcacttcaccgtcgtcaaggagacggtctccggcggtgtcagcctctccaccggcgtcagccgctccttccagtccgtcaactacccgacccgctactggcaggagcagtcctccctgctcaacctgcccgtggtgagctccgccgccagcagcgcggagaaggcggcgtcggcgttcacggtcgtggcgggcctcgccgacgccggcgggtactccttccgggacgcggccggaaactatctgcgccactacgactaccgtgcccgcttcgacgccgacgacggaacgccgacgttcgccaaggacgccacgtacgtcgcgcgaacgggcacggccgccggctccgtccgcttcgagtcgtacaactacccgggctactatctgcgccactacaactaccagctgcgcgtggaccccacggacggcaccgaccagttccgccaggacagctccttcaacccggtcaccgcctgggcctgagccctcttccggccaggcggtcgccgcccgcccggcctcgaaggtgaccttcgtcgccggcgcgagccggcgatgcgacgtgcgggcgttgagcaagctcgtgccgtacggacgtagcaaaggacatgcctgcattcatggccgacagcggcgagcacacggcggtccgggatccgatcggcccggtcccgccggcgagcggggaggacgattcccggaggccggcgggccttggccggcggctgcggcggtaccggcggtggctgctggtgtgcgcggtggccgcgttgctggcccagatggcggtcgcgatgatcaccacggcggtggaacagacgcccaccatcgacgagccggtgtacgcgggcacggccgtggtctacgtgcaacagcacagcctgcgttacaaccccgagcacccgccgctcggcaagctcatcatcgcgaccgggatggcggtcgcccggccccatctcgcgccggggttcgtgggcgaccagggcgagctgggacggcatctgctgtacgagtccggcaacgacccctggcgggtcatgttctgggcgcggctgccggtgatcgtcgtgacgctgctcctcggtctcgtggtcttcgcgttcgcgcgtgatctcgtcggcgccgtgggcgggctggcggcgctcgcgctgtacgcgttctcgcccgatgtcgtcgcgcacgggtcgctggccacgctcgacgtgcccgccgccgggttcgtgctgacggcggcctggctggtgtggcgggcgcggcgccggccgctgccgtatctgccgctcgccgggctggcgacgggcgccgccctggcgacgaagatgagcaccctgccggtggttccggtgctgatgtgtcttgccgggtggtcgttctggtgcgcccggcggaccgacggccccgagccacgggagcgggcgcggctcgcgggccgggccgcggcggtggccgccggtgtggcgctggtcgcggtggtggtcgtgtgggccacctatctcgtcgtcgatccacggctgcggtggaccgcgtccgggcatgtgccgacggtgcacggcctgcgtgggctgctcgtcgagtggctgccgttcccggaggcgtaccgggacgggatgcgcgtccagttcggcttcgagaacgcgacctggcacggcttcctgttcggccggctctactccggctccctgtggtactacctgcccgccgcgctgatcgtgaagacgccgctgggcatgctgggcctgtggctggcgggcgtcggcgtcatggcggcggtgccgcggctgcgggcggcggcggggtacgtggtccttccgcccgccgtcctgctggccgcggccatgaccggctcacgtgatctcggcgtgcgctacgccctgttcatgccggtgttcctcgcggtcgccgccgcctgcgtactcgccctgcggcggtggtgggcacatctcgcggtggcggtgctggtcgggttcgtcgccgtcagttcggtgcggacgtttcccttgtatctgccgtactccaacgaggcgttcggcgggcccgccgagacccatctgcggctgcacgactcgaacgtcgactggggccaggacctcgggcggctggccgaccggctgcggcagcggtatcccggcgagaaggtctggctcgtgtacaagggcagcggtgtgcccgccgcgtacggcatcaccgcctccgacccgcgcaaggtggcgcccggccgggtgcacgggctgctcgtcgtgtcggactcgtcgatcgccaaggccgagggccggttcgcgcggctgatcgacagcagcgaggcgatcgacgaggtcggacactccatcacggtcttccgccggaagtaggacgagcggcggtccccgcgtcagggagaggacggcttgcccgccgtaccgatccacgtgtggaacaactggtcgaggtccttgccggagagccgctccgccaaccgggtgaactcggccgtcgttccgtggccgccccggtggtcggtggcccaggtgcgcaggacgcggaagaaggtcttgtcgccgaccgccgtgcggagcttctgcagggccatggcgccacgggcgtagacgggagtttcgaagatatgggctccgctgccggggtcggcgggcgggaacgcccacaggtcgtcgcccgccggggacgcgtacagggcgtcgaagatctgctgagcggtcctgccgccgtgctgttcggcgtagagccactcggcgtatgtcgcgaaaccctcgttgagccagatgtcccgccagcgggtcagtgtgacggagtcgccgaaccactggtgggcgctttcgtggacgagggtgctcagatcgggggcgctgtcgtacaccgggcgggtctgggtctccagcgcgtagccgacgttcggggcacggtcgacgacggcaccggcggccttgtaggggtacgggccgaaaacgccgctctcccaggcgagcacggagggcagcttcttgagcaccggtgttgccgcggtcgcctcgcgcgggtcgacggcgttgtagaccttcaggccgtccggggtcgtgtaccgctcgaccttgaacgtgccgaccgtcgcggtggccagataggcggccatcggctcggactgacgccagcggaaggtcgtacggccgtgggcggtccgctgtcccagaaggacgccgttggagacggcggtgcgccccttgggcaccgtgatggtgatgtcgtacgacgccttgtcgctggggtggttgttcgcggggaaccaggtcatcgcgccctggggctcccccgcgacgaacgcgccgtcgtcggtggggatccagccgtcgagcgagccgtcggggtcggtgaccggtttgggcttgccctggtaggtgacggtgacgcggaattcctgccggcggtgcagggcgtggcgcggggtgacgacgagttcctggccgtcgcgccggaaggcggccttggtgtggtcgaccgtgatgccggtgaccttcaggcccgagaggtcgaggtcgagacgggtgaggcgctgggtggcccgggcggtgatgaccgcctttccgtcgaggtggccggtgctcgggtcgtagccgaggctcaggccgtagtggcgcacgtcgtagccgccgttgcccgcgagggggaagtacgggtctcctgctccggacgagcccacggtgccggccgccgccgggcccgcggccgccagcagcgccgcgagcgccacggggacggtcgccaccacggcttcccgacgaaggacggttgcacgtctgacggcctgtcggcgggctggcctcacgttcgctcccacgagttgacgatgatcactcgcgaaagcttatgggcccgctcgtccccggaattacctcgatccggtcaaattatgtcgtgtctagtcgcgtctatgggtttgaccgtctcctccggcccggggtcaggtgtggcccagccccccgctgccgaacgagccgctggagccgggatcccagcgccgtcgattctggtcctctcgccgtttgcttcctgcgtggtgcagctcgtacggcatgagccgttcactctcgaccgccgcgtgcggcacttcgtcgggttcccgcatctcacgcatttcgtgtactgcaccggattcggggagcttgggctgctcgtccgagcgaggccggtccgattccgtacggcgcaccgatatgccgagccggacggcccagatcagtccgccggcgatcaccagaccgccaacaaaagcggcaaacacgttgagtacatcactcgacgcggccagtagttcatagctcgccgtgttcatatgcactcaatacccgtaaataaatgccgataagcaaaaacatccgcgagattcatttatgaggttcggtgggcgataccgggccggtgccaccccacgggcccgtcggcggcccgcgtccgggtgcgacgcggtggacgaacggggtgtgtacgtccgtcccgcgagcgaacgcagcggggtcactcggatgcggacgcgcggaggcttcacagtgttcatgaagccaccctgcgtcacgggggcccggcgggccaggcctctcctgggagcaggaccaccggtcctggtaccggtacaaccaggctccgcgacgtcactcgggccggtccgcgtccgccggcctggccggcggacggtacggcgccagaccctgtcgtcagatccggtaggtgcgcagggccggtgtggcgaaggccagggccagggtggcgacgacgaccaggagtccaccgcccgcgacggccgcgcgcgccccgaagaccgagcccgcggtgccgtgcagaacgtcggcgaggcgtgggccgcccgcgaccacgacggtgaacacgccctgcatgcggccgcgcatctcgtcggtgaccgccgacagcaggatggcaccgcggaagaccatcgagaccatgtcggcgactccggcggcggcgaggaaggccaccgcgatccagaggttcgtactcaggccgaagccggtgaccgcggcgccccaggcgacgacggccgcgatcaccatgaggccgtgcctgcgggcgcgcgagaacgtgcccgacatcaggccgccggccacggcaccgatggggatcgccgcgaacagcaggccgagcgcgaggccctccccgtagggcgcgtacgtctgcgcggcgagctgcgggaacagggcccggggcatgccgaggaccatcgcgatgatgtcggcgaggaaggagagcagcaggaccttgtgcagcgagatgtagcggaagccctcggctatcgcccgccagccggcgcggccggacgccggggtcgtcaggggcggcagcgcggggagccgtacgaccgcccacaccgtggcgcacagggccagggcgtcgagcagatagagctcggacaggccgatgacggggatgagggcgccggccaggagcggtcctgccaccaggcccgtctgcatgacggtggagccgagggcgttcgccgcgggcagttcgtccgcggggaccagccgggcgatggaggcggtgcgggccggggagttgaggccgaagaaggcctgctggagggcgagcagcgccatcaggacgaacaccgagtcgaccccggtgacggcctgggtccagaacagcagggaggtgacggctatgccggagttggtgatcaggagcagcttgcggcggtccatgctgtcggcgatcgcgccgccccacagggcgaagacgacgagcgggaggaggccggcgaggctggcgtagcccacccatgccgacgagccggtgatgtcgtagatctgcttgggcacggcgacggcggtgagctggctgccgacggaggtgacgatggtcgaggaccacaggcggcggtaggcggggcgccgcagcggcctggtgtccatcgcccagcggcgccagcccgggcgggcccctcgcgccggtgccgggggcacgctgggcgccgcggtgtctgggccggtgctgtcgtcggtgctgctctcactcgtgtccacggagttcctggttgctcgatacatccttctggtgtcagggttcactatcgcccacccgcaccgggccgacatcgggcgggtggacgggagttcagacgccggcgatcagggtggcgcccatcgtgagcatcgtcgcggccaccagggcgtccagcacccgccatgccgacgggcgcgccaggaagcggccgagcagccgtgagccgaagccgagggcggcgaaccagcacaggctcgcgagggccgcgccgagaccgaaggtccagcgcagtgagccgcggtcggccgcgatcgagccgaggaggaagacggtgtcgaggtagacgtgcgggttgagccaggtgagggccaggcaggtgagtacggcgcgtctgcgggagccctccggcgcgccctccgcccgcaggcccgccggacggaacacccggcgcgccgccagggcgccgtagaccagcaggaacgcgccgccgaccagcgcgaccgccgtcagcgcccggggccaggccaccacgaccgcgcccacaccgccgacgccgagcgcgatgagcaacgcgtcggacagggcgcagatccccaccaccgcgagcacggcgtcgcggcggatgccctggcgcaggacgaaggcgttctgggcgccgatggcgacgatgagggagaggccggtgccgaatccggcggcggcggtggtcagggcgttggtcatgacctcgacgctagaaaaagcaccgccgacagtacagctaaagattcttacgtatcattagcgctcgtgatggcggagctccctctcgacctggtacgcaccctgctcgccgtggtggacgagggcacgttcgacgccgccgcgagcgccctgcatgtgactccttcggcggtcagccaacgggtcaaggctctggagcggcgcacggggcgggtgctgctgatgcggacgaagccggtacgtccgaccgagtcgggcgaggccgtcgtgcggttcgcgcgccggctggcccgcctcgaactcgacgcccgcgccgaactcggcatgaccggttccgaggagccgacccggctgtcgatcgcggtgaactccgattcactggccacgtggttcctcccggcgctggcccgcgtgcccgaggaactgcggctgtcctacgaactgcgccgcgaggaccaggaccacacggccgcgctgctgcgcgagggcctggtgatggccgcggtgacctcgtcgccggacccggtgaccggctgctccgtacaaagtctcgggcggatgcggtacatggcggtggccggcccgggcttcgccgcgcggtggctcggtgaccggccggacgtgccgctgcggcaggtgctcgcagacgcgcccgtggtgtgcttcgaccggcgcgacgaccttcaggacggctttgtacgggggcttcggcgtggtcggggcggcgcgagcgcgctgcggcacttcgtgccgacgtcggagggatttgtcgacgcggtcgccgccgggatgggctggggcatggtgccgcaggtgcaggcagagccgctcctgcgggcggggcggctcgtgcacctcgccacggaccggcccatcgacgtaccgctgtactggcagcagtggaagctcgactcccccgcgctgtcggccgtggcggaggcggtggcttccgcggccgccgcggccctcgacggcgggagccaatggccgcacgtcacctccgccgtcaccggccggggatgaacgcccgcgcagtcccgcgagcaccgcaccaacaccgcccgactgccgtgcgcggaggcggacttcggcaccgggccaccgcgggtggaaactcctgagtcctcggtgaattccggaatccaccgtgcctgggtgaaacgaattccggcgtatttcttcggcaccttcgaaacgatcgttgacgcaaccgtggtgcggtgcaaacgtcgcaccagtcctcccggccggccgggacccggggcgacgccaggcgggcgtcgcccacaaacggcgaactcaggcgaacggaggacctctcgcgatgtcaacagccagcggagacccgacaacagggacggccgacttctttgcggcgcccctggcggatgcctcgctccccgaggagtgggagagcggccaacaggcggtcaccgagcaggccaccaatccggcgagcggcaccgacgagatgtcggcgcccgaagagcaggtcacaaggacatccgcgacaccactgcccggcgcaccgaacggcgccgccgcgctcccctaccgtcccacccgcggccgctaccgcagcagcggcggcggcttccacctggagttgcgggtcgacgtcgacagcacggcgggcggcccgaaggtcctcaacaggatcagcggggacttcttcagcaccagcggcgccacgacgacgtactacgggtcgttggtcgtgcacgcgcccaccgtcacccggtccgccacccaggtggtcatcagcggcctgggcacctacacctggcaggccggcgccccgatcgtccgggtgaccattccgcggcgccggatcaaccagccgcagggcaccgccaccgtgcagttcctcaccacctccaaccagcccggcgccggctacacctgcgggtacgtctccccgtacttccgcaccgtccagtgggagcaggactcggtcaccggcaggattccgttcctctcctacgacaccgggtcgctcccgcagccgccgaacagtcccgcccgggcgctcaccgtgccccgcgcgtacgccgaggccggtatcgagctgctcatgtccggcaccgccaacaccatcgccgacagcccgggcggctggaccaacaccgaactgcacggcgccatgcagaccaacttcagcctgtggcgcgacgccccgcagtggaaggtgtggctgctggtagccggcagctacgaaggcatggcgggggtgcgcggcatcatgttcgacgccgccgactccttccagcggcagggctgcgcggtcttctacgacctgatcaagggcaccgacgccgagtcgcagcgcgcccagctgcgcacgtacgtccatgaactcggccactccttcaacctgctgcactcctggcagaagaacctggcgcagccgccggcgccgctcggtccgcagaacggcttcggcgatctgtcctggatgaactacccgcagaactacctgccgccgacgggcaccggcggggcggccgcgtactggggcgccttcccgttccagttcacggacaacgagctggtccacctgcggcacggcttctaccgcgacgtcgtcatgggggccaacgccttcggtatcggtgccgccgacatcgaaccggaactgttcgacgagcccctcgccgacgagtccgggctgcgcctggacctgcgggtcaccaagagcggcttcgcgttcggcgaacccgtcgtcgtggagctgaagctggacacgacggacctgcgcggccgctccacccacgaccacctccacccggacgacgaactcgtccacatcgccatccggcagccctccgggcgtaccgtgctctaccggccgctgctgcgccgctgcgtcgaccaggacgcgaccgtacgtctggacaccgaccggccggcgatctacagcagcgcctacatcggctacggccgcgacgggcactacttccagcagcccggcacctatcagctgcgcgcctcctatctggcgtccgacggctcccggatcgtctcgccggtgctgcgtctccacgtccggcaccccgtcagccagagcgacatcgagctcgccgagctgatgatgggtgaggaacagggcacgatcctcgccctgcgcggctccgactcgccgtcgctacaagccggcaacgacgccctccaggaggtcatcgagcggcacgccaaccacccgttcgccgtgtacgcgcggctcgccaaggggctcaacttcgagcacgagttcaagagcctgagccccgacaaggccggcctgaacgtgcgtcccccggacaccaagtccgggatcgagcagctcagtcaggtcgtgaaggtctccgagcagggcaagggggtcgacaacctgaccctcaacctggccacgcggcgactggcccgtgcctacgcccgccagggcgatctggaagaggccggctccaccctcgaccgactggtccggcacttcgacaccccggcgttcaagccgtacgtcgtggacgcggtccgcagtcaggcggactccacgaaggcccggctgctggccgagttcggcgacagctgagccgcgggacgaaggccgcgcacgggcgcgcgacgcccgtgcgcggcctctgtggcagcatcgcgtacaggccccggaccggggcggggaaggagccggacgtgctcgatctcgtcctgtacgggccccaggggccgcagccgctcggcggttccgcgccggtccgggcgaaggtgcggaactcgggtgaacgtgctgtgtggatcgccggggtgctcgacgggtccgaggacggcatccgctttccgcactatctccccgccgtcaccctcgccgacggcggacgcaccgtcgcccggcccggcccggccgaggacccgctcgtcgggccgttgcgggtgggccatctgcttcggctggcgcccggggagtcgttcgatcccacggccggtgccgggtgcctgccgctgacgaccttcgccgcgttcgccccccaagcccccggccgctaccggtacacgctcaccctctccaccgaggcggggcgtcccgaggagtggctgggcggtttcggtctgccgtccggggccgagcgggaggaattgctggacctgatcgcgcgggtcccccggatcaccgtgtcggccgctccgctgatcctggagttccgctgagcaccggcacttcgaggtcgttcaccgctcggccatgacgaggacgagggggacgccgtcgcagggcatcaggtgcaggccgtcgaagtgttccggccgggcctgggtgaggacggcggcgaagtcggggcccttggtgagggagccggccaggtgtgcggggtcggcggaggcggcgacccggccgcgcgcgttgaccaggtgcgccgggcccggcagccgttgcagcaggggcatcacggccgtctcgaagtgccgcagatacacatccgccgcggccacccccgcgaaccgcccctccacctgcaccggcgcggacagggtgaggctgtactcctcggaacacagatagtccacatacggcccggccaccgcccggcgcccggtgtcacggggcagcgcgaaccagtcccagtgcgtgtaatccgagtacgccgactgccgcgggtccaggtcgagcagcaacggccgcagcgccccgtccgcaccggtctgccaccactccagccacgtcggcacatcgcccagcagccccggcgcggccacgaaccccacccccgagaccagctcctgccgcgccagccgcagatgaagccccggccgcagcccggccagatccacggtcgccggccgacgacccagcccggccacttgcgccagcaacgccgccgtgtccgcccgcgtctcctcgacggcctcgaacaccgcctccagcgcggaacgcacctgcgccgccacccgcgcctgcggcgacacatccagcgtcgccgttgccgggcggccgcttcccgcgggcgcgggcaccggatgcgccgcgaggcagaacgaaaggccgggctgtggaatcgagtggggcatgaccgcgaccgtatacgcagaattccctcttccgcatcttgactgtccgtcaactcctcttcaacacagcgcagttgctacacatgccgacgctccgtaaggtgtggatcacccgggacgccggaggacgccacccgccctccaggcggccttgatgctgggtgcggcccgcctgaaccctccagcagatccggagatctcgcccgaggacgccactgtgatccgtggcgccccaacagaatccggtattccgtccccttcagccccttcctttcacctctcccccccacacccacacaccgtggagatttccttgcgtttgcacagatccttcaaagccgcggccgcggccggcgccctgctgctcgtcagcggctgcggattgttcacggagtcggacgcctcgtcctcggcgtacggtctcaacccgccggatctcaaggcgcagtcgaagctcggcaagaccgagggccaggtcaacctcatcgcctgggccggctacgtcgaggacggctccaacgaccccaaggccgactgggtcagcagtttcgagcagcggaccggctgccaggtcaagtccaaggtcgcggccagctcggacgagatggtcaagctgatgaagacgggcaactacgacgcggtctccgcgtcgggcgacgcctccctgcgtctcatcgcctccggcgacgcggctccggtcaacaccgacctcgtgcccaactaccaggacgtcttcttcggtctgaagaagcaggcctggaactcgttcgacgggcagccgtacgggatcccgcacggacgcggcgccaatctcctgatgtacaacacgcagcaggtgaagcccgccccgacctcgtggtcggcggtcttcgacgacgcgtcgccccacaaggggcacgtcacggcgtacgactcgccgatctacatagcggacgcggccctgtatctgcgcgagacccagccgggcctcaacatcgagaatccctatgcgctcgaccaggaccagttcgacgccgccgtggccctgctgaaggaccagaacgcgaacgtcggcgagtactggagtgactacctcaaggaggtctccgccttcaagagcggcgactccacggtcggcaccacctggcaggtgatcgccaacctcgccgccgacgaaggcgccaaggtcaaggccgtcctgcccatcgaaggcgccaccggctggtccgacacctggatgatctccgccaaggcgaagcaccccaactgtgcctacaaatggatgaactggatcatctctccgaaggtcaacgccgaggtcgccgagtactacggcgaggcgccgtcgaacatcaaggcgtgcgacgagatcagcgacgacgcgttctgcgacacgtaccacgcgacggacgagggctactggaaggacatcgcgttctggacgacgccgatcgagcagtgcctcgacgggcggacggaagtgaaatgcgtgccttacgccaagtgggtccaggcctggaccgagatcaagggctgagcggcaaacgcgcgggcacgcgctcaggaagcggcgatgtcgcgctgctgccgggcgagcgcgtgcccgatgtcccgggtcgccggatacaggcgcagatacaggtcgtacaggtcgtcgtagcggggccgtagccgggcgtcgggggcgacctgctcccgtaccggattccaggcgtcgatgtccgcgtcgccgaccgcctgcgcggccaggaacgcggcgccgtagctcgctccgagcgtgacggtcctgatctcctgttccaggccggtgacgtcggagacgatccgggtccacagtccgccgcgggttccgccgccgacggcgacgacccggtggacgtccgcgccggccgcccgcatcgcctcggcgttgtgccggacgccgaacgcggtcgcctccagcgcggcccggtacagatcgccgcgcgtgtgctccaccgtcagcccggcgatcacgccgcgggcgtccgggtcggcgaccggggtccgctcccccgcgaagtacggcagcatgagcagccccttcgcgccgggccccgcggcctccgcctcggcgaggagcgcgctgtgctcggggccgccgaacaactcccgcagccagtcggtgatcacaccggaggtcgccatgccgcccgcgaggttgcgcgtgccgggcaacgcgccgacggtgctccagagttgcgggaccagcaggcgttcggtcaccgtgttgatcaggaacatggtgctgccgtacatgagcatgaggtccccggtgcactgggctcccacgctcagcgcctccgaccaggcgtcgatcgtgccggtgacgacggggacgcccgcgggcagtccggtggtggcggccgcctcggcggtgaggtggccggcgatgtcccccggccagccgagccgcggcagttcgatccagggcgcgatgtgccgggcccagggcgcgtaccactcctgggcgacggagtcgtagagcgggacggactggctcgcggagtggtggtcgagcacgtacgccccggtgagccggcgcacgagatacgaactcggcatgtacagccggcgggcgcgggcgatgacgtcgggtgcgtgctccgccagccaggcgatcttgggaccgacggcctgggtggagagcagggacccgcagcgttccaggacggcctcccgccccaactcggcttccagccgggcgatctgctccgtcgcacgggtgtcgacgccgtacaggatcgccgggtgcaacggcgtgtcggcctcgtcggtgagggcgacacaggggcccatgccgctgacgccgaccgcggtcacctcgctgccccggccggtcagctcacgggcgagggaggcgaactcgtcccaccacacgcgggcgtccagctccacgtgcccgggtcgtggacggctgacggtgtgcggtcgtacggcggtggcgagcaccgttccgtcctggtcgacgaggacacccttgctgctggacgtgccgatgtcgactccgagcaccgtcccacgctcacgcttgcgcacacccggagcgtaggcgatccgcggccggttcgccgtgcggcttgtcgatgcccggcagccgcggggtgaacaccgggccctcgaccgaagggctcgtgcgcggagttgttgccgtttccgtacgcctccgatcttggcggaggcgtttcctccgggacaggatgcccgtatgaagggtgacctgttttccagtgaccacatggtggagcccgccgtcgcgccgggcatgaccgtgcagaacgccaagtccatcaagtacgccgtgaacggcgacatgctcgcgcggcagggggcgatgatcgcctatcgcgggaacctgcagttcgagcgcaagggccagggcgtgggcggcatgctcaagcgggcggtcaccggcgaggggctgccgctcatgaccgtgcgcgggcagggcgaggcctggttcgcgcacgaggcgcagaactgcttcgtcgtgggcatcgagccgggtgacgtgttcaccgtcaacggccgcaatgtcctgtgcttcgactcgacgctgacgtacgagatcaagacggtgaagggcgcggggatcagcggcggcgggctgttcaacagtgtcttcaccgggcacggcaagctggggctgatctgcgagggcaaccccctggtgatacccgtgtcgcagcagcagcccgtgtacgtggacaccgacgcggtggtgggctggaccgcccatctgcacacctcgctgcaccgttcgcagtccatcgggtcgatgctgcgcggcggttcgggcgaggcggtgcagctgaagctggagggcgacgggtacgtcgtcgtacggcccagtgaggcgacgccgcagaaggtgcagcagcactgaccggccgaccggaaggggccccgccgtacggcggggcccctggtgcgtcagcctccggtggagcgtcagcgtccggtggacggggtgttggcggaggtcacgttgaccccggcccaggccttgtcgaccgtctggtactcgatgctgtcggcgccgtacatgtcggtggcggccttcagcgtcgcgttgcgcgcgtcgtggaagtccgtcgtggagaccatgtagcgggtcagcgcccggtagaagatcgcgagggccttggcccggccgatgccggtgaccgtcgagccgtcggaggtgggcgagttgtacttcaccccgccgatcgtcttcctgccgcttccctcggccagcaggtagaaggcgtgcgaggagacaccggagccggcgtggacctcggtgtcgtacgtctcgggcgaccagtagtcgatggtcccctcgagcttgtcgcgcgagggctcgtcgagacggcgcaggaacttctggtccaggccgagcttctcgccgacgaggtagtcacccgcgtccttggagttgttggtcgcgaactccatccccgtgccgaagatgtccgcgagcgactcgttcagcgagcccggctcaccgaactggttgccgtcccggtccacgcgggtgggttcgagggcggcggtggcgtcgacaacaccgtgggtcagctcgtggccggtgacgtccaggacgaccagcggcttcttgaagaggtcgccgtccccgtccccgtacagcatgcagccgcaggcggagtcccagaaagcgttgccgaccttggtgccgaagtgaaccatcgcgcgggcgccggtgctgttgttcttgatgcccttgcgcccgaacgtcttcttgtagaagtccagggtcttggtgacgccgtactgggcgtcgaccgcggcgctctggcggctactggtcttgccggtgccccacttgttgttcttgtcggtgaacttcttgccgcgcgagaaggcttcgaggtactgccccttggcgtcccgggtctcggtgccccagcgggtggagtccttgaggaggaagctcgtgcgggcggtctgggtggtgctcagccccaccttgccgacgaagagggaggtaccggtgccggaggccttgcgcgggtagctcgcggccccggagatgcccgtcagaagcgaggagccggtgagcgcggagtcggcggtgccggtcgcggggttcgccgtctcgccccgctcgcgcagggtctgggccagcgagggcgagatgaactcgtcgctgtcgggggtgttgctgcggatgcggccggtgacggcgtcgacgacgaccgtgcgggagccggtggcctccgtggtcttgctgtcggtcacccgcacctggtaggcgagggcggagccgccgtcccgcgcgtccacgacgagtgcggcctcggtggcgtcgccctgggcggccgcggcggccttctgctcggcctgcgcgggcgtcagcttcgcctggccggcggcggccggcttgaccgtgtggtcggcggcgcgggtcacaccgaggtacgtcgagcgcttggtgaggtggacgaccaggtcaccgccgaggaccggcaggccctggtgggtgcgcacgaaacggacgtgctgcttgccgtccgggtcggtcaggacgtccttcgcctccagggtgtccccccgggagacgccggtggcggacgcgtgggcgaacgctgccgcccgggccgcgtccaccggcgaggaggccgcagccgcggcgagggcgggcgcgtcggcgacagccgggaccgccgggagcgtggccgccgtcgtcacggcgatggcgatggccacgccacgtatgtggggtctacgcactgatttccttcgaacatgggcggccgggaacgccaaccacccgcacacacagcgctgttgggcgctgcgggggctggtcgggccccggtgcaaaaccctcaccgattcaccatgtacatgtaaaggagaaagatcccttttactagcttcgaggtgatctctttacaaatgttcacctgtgagtgatgaaccggtgaccaactgtgcgttgcctgtacagatgtgcgagaccacgaagaggttgcgtcccgggccgcccggaccagtggatgtgaccgaagtcgcagcgcctccggccccttacggccggaccggaggcgagccggcgtcagatcgtgcgccggctgagggcggagagcagggtgcgcaggtcggcggcgggacgcggggccggctggacggaggccaggagtccgtgcgccacggtgagatgacggcgggcctcccgcagcgcggccgagcgcccgcccgcctgttccacaacggccgccgcccgcaccaccgcggtgtcgtcgcgggccgtgaggagaccctcgagcgcggagccggagggggtggccagcgcggcgagaaccggaaaggtcttcttcccctgacgcagatcgccgtggacgggtttgccggtgaccgcgggatcaccccagatgcccagcagatcgtcgacgatctggaacgccactccgagatgacgtcccgtccggtccagcacggcggccgtctcctccggcgcacccgcgaggtgggcgcccagcgcgagagcgcagccgagcagcgatcccgtcttgtgctcggccatcgcctcgtactcggcgacgctcaccgcctcgggcccggtccagggccggtgggcgaacagcaggtcgtcggcctgcccccgcaccaggtcaccgagggccgcgctcagccggtgcgcggctccgggcgcggacgcggtggtcagcgtctgcacggccagggcgaacagggcgtcgcccgccaggacggcggggcccgtgccgtacgccttccacagcgccgggcggcctcggcgcatcgcgtcgccgtccatgatgtcgtcgtgcaacagcgagaaggtgtgcacgagttcgaccgccacggcggccggtacgccggcttccgccggccctccggcggcctccgcccccagcacggcgagcgcctgccgtacgcccttgccctgactgtgcgcggccggggcgccgcccgccgcgccacggcccagcgcgtagtcggccatctcccgcatccatggatgcatcccgccgacggcctcggccagggccggggcgaccagttcacggcagcggtgcaatatggcgggcgcttcgggaccggccttcagggccgtcgtcagggtggtcatcggccggcctcccgaccggccgacgaccgcggcgcgagaccgagttcctcgcgcgccccacggatgagctcccggccgtgccgcaggccgatgccgtccagcacgccgacgagttcgtccagctcggcaccggtctcggcacggtcgcggcccaggcgggccagggacttgaccaggccgaggcgggccagggcccggccgcgtggctcgctcatcccgtcgaactcggcgagcgcctgcgcgtagacctcccgggcctccgcgtaacgcccggcgcggtagaggacgttgccgcgcatcttgtggttgtaggccagcgcgctgacgaggttcatctcccggcaggagacctcggcctcaccgagcagggccagcgcgcgctcggggtcccggtcgcgcacggagacgatgtcggcgagaccgcgcagggcccaggcgtgaccgcggcggtcctcggcgcccgcggcgatcgcggccgcctcctcgaacatggcgtacgcggtgtcgtacgagccggtgttgcggtgtatctgggcgatgccctccagggcccagacggtgtggcgcgcctcgccgcgtttcctggcctcggcgaggagctgctcgtgcagggtggtgacggcctcgtaatcgccctggatccgaccggtttccgccattcccgcgagcgaatagccacgtacgacgacatcgcccgcgtgcttgccgagttcggcggccagtcgcagcagccgccaggccagaggcagggcgccccgctggcgggccagggtgccgccactccacagcgcccacgccatcgcgccggtgtcgccggcctcgcgggcggtgcggtagctcgccttccaggcccgctccgcgtccgcgacctggccgagccggcggtgcgcctcggccaccgccagaccggagcgggccgcctcgccccgcgccccggcgcgctccgcggcgcgcagctgttcggtgcccgcggccaggacgtcggtcagcgaggagttcaccgagagggtggtcagagcgccctggtactccggggcgaaggccttgccgtacatgagtgcctttcgatctgccgccggccggggcgtatggcctcggccgtcgggtgctggctgtcacggggtgggcggcgccctggcggaccagctatgcactccaggcatacacgtcacgtatacacaccatgtatacacagagcgtatagcacaccggacatccacccgggaaacctgggtccatggatccgccgggctgctcgcccgtcgccgatcaagacgtcagccgggcccccaaggttgcttcacggcaaacgagttggctcgcacgcgcacatcactcgtcacgattagaacagatcttcgaatatcgaggtacgctgcacctatgtccacgcacctccagggatcgctcttcgaccagaccgacgaactcgggctcggcccgctggacggcctgcgacggaccgtcctgggtgccggggcctggatcgatctgctgccgggctggctcagcggcgccgacgccctgttcgaacggctcgccgccgacgtgccgtggcgggcggagcgacggaagatgtacgaccagacggtcgacgtgccccggctgctcgcgtactaccgggcgggcgacacgctgccgcaccccgtcctcgccgaggctcgcgacgcactgtccgcgcactacgtggccgagctcggcgaaccgttcaccacggccgggctctgctactaccgcgacggccgcgacagcgtggcctggcacggcgaccggatcggccggggcgcccgcgaggacacgatggtcgcgatcctctccgtgggcgcgccccgcgatctggccctgcgtccgcgcggcggcggcgacgtcctgcggcgcccgctcggacacggcgacctgatcgtgatgggcggctcctgccagcggacgtgggaacacgccatccccaagagcacccgggcggccgggccccggatcagcatccagttccggccgagcggcgtgaactgagcggcctcggtgtcagggcgtgaggtgcatctgcacggccggggcgtagcggtcgacgatgtcgtcgatggcggcggcacgcagatgggtgccgcgggcgatgccgaacatgacaccgaggccgagcagcgcgctcaccgcgagttcggcacgcagaccggcgtcggggccggccagtcgctcggcgaggcggtcgccgacctgggcgcggaagttggcgcgcaggatgtcgccctgttcgccctggaggggtgcgaagacgatgcgcaggacggggtcggcgccccgctcggtctggccgaccagcacatgccggaccatgtgccggccgaggtcgtcgaggggcgcgtccagcaggtccgggacatcggcctcgaaggacatcacgcgggcgaagagcgcgtccttgttgccgaagtacttcagtatcagcggcgggctgaccccggcccggtccgcgaccgccttgagggtgatgtccgcgtgggcgtggcgggccagcagatggcgggccgcgcggaggatggccgccttggtcgcctcggcgtcacggcgcgccggggcggcggccggcggggtggcggcggagggagtggtcatggtgctcatgctccttccagcgcctcgtcgtgggacggccgggtacggccgcgggcccgtcgcgtgccgtgggagtcggggtccccggggatgacgagggcggcggcgcaggccatcactgcgaccgtacccgccatcgcgaacgccagcagatagccgtgcagggtgggtaccggggcgcctcccaccaggctggtgtggtggaccaggacggcggcgaccgccgcgctgcacacggcttggccgatggtgcgcatcaggacgttgacgccgttggcggaggcggtctgtccggcgggcacggcacgcaggatcagggtgggcagggccgagtaggcgagggtcgtgccgaccgcgatgaccgtggcgcccacgatgatcatccacaggtcgcggctgtccgcgatgcgcacggcgtagccgacggcgatgaccgcggccccgagtgccagcgtcacgcgcgggccgcgggcggccgagatgcgcgccgagaccggcgagaacagcagcatgatgacgccgccgggcagcaggcacagaccggtctgcacgatggacagcccgagtccgtagccggtggccttgggcgcctgcaccagctgcgccgtgaccagcgagttgccgtagaaggcgaatccggtcagcagcgcggccacgtgcggcagggcgacccgggggcgggaggccagcttcaggtccaccaggggccgcggggcccgccactgctggaaccaccacagcgtcagtacgagtacgcaggccacgagcaggccgacgatccgcggactggtccagccccactgcccgccctgcgacacaccgaggagcaggcagaccaggcccgcggccagccccagcgcacccagcgtgtcgaagcggcccggctgccggacgggcgactcgcgcaccgcccaccacgccagtgccagtccgccggcgccgagcccggtggtcgcccagaacatgacgtgccagtcggcgtactgcacgatcatcgcggcgatcggcagaccgagcgcggcgccgatgcccacggtggaactcatcagggccaccgcggaacccgtgcgctcgggcgggagttcgtcgcgcaggatgctgatcgacagcggtacgacggcggccgccgcgccctggagggcccgcgcggcgatgagcacgcggatgtcggaggtgacggcgcacagcagcgagcccagggtcatcagcgcgagggcggcgagcagaacccgccgcttgccgtacatgtcgccggcccggccgagcaccggggtcagcaccgcgccggagagcagggtggcggtgaccatccaggagacggcgcccgcggaagcgccggtcaggcgcggcaggtcgggcagcagcggcaccacgaccgtctgcatgacggccatgaggattccgccgaacgccaggacggggaccgtcagccggtcgcggacacccggccgtccggccggtccgtcgggggtcgcggaccggtcggacggggtggatatcgggaccatggtcactccaggggcggcagccgacgtgaagaagggaggtgaataggaattcaccttagccgggtgaatggtcattcacccagaattctccgtcggacgcggccgccggcggccggcctaccggcccgtgcgcgcctggacggtacgcgccagtcgcggccccagccagcgcttgagcctgcgcagcgcctccagttgtccggccgcccggtcgatccggtagtagagctgcggaggcacgtacggcagcagcggggaatggcgctggccgagcagggcgaacatctgcgggggcggaaggcggatgtagcgcgggaggttctcgtaccactgggcgctgagccgggccgcgctctggatgtgcaggagcgcggacttgcgttcccgctcgtaggcggcgagcgcgcccggcaggtcgcggtgcgcgctcagggcttcggcgagggcgatggcgtcctccagggcgagggtggtgcccgcgccgatggagtagtgggtggtgtgggcggcgtcgccgatcaggacgaggttgtcgcgatgccaggtgcggttggtgagggtgcggaagttcagccactgggcggcaccgtcgctctgcgcccggccgatcagctcgtgcccgtcgaggacgtcggcgaagagcttctccagcagggcgagaccgtcggcctcgctggcccggtcgaggccgagcccggtccaggtttccggggagcactcgatgacgcaggtgctgtggccgtcgctgaatccatagccgtagcaccagatccagccgtgttcgctctccacaaaggcgaaggtgaacgagtcgaagaccttggtggtgccgagccagatgtagcggttgcggccgagcacggtctcgctgccgaagtggtcggcgtagcggccgcgcagcacgctgttgaccccgtcgccggcgacgaccagatcggcctcgggcagtgggtcgtcggcgccgatctcatgctcgtactcgatgcggacgcccagggaccgggcccggtcggccagtacgtcgaggaatctgcggcggccgatgccgaagccctcgtcgccgtggtggaccgtggtgcggttccggacgtgggcgactccgtcgctccagcggacggagttctcgctgacggcgagcgccgactcggggtcactcccgcggagtttgtcgagcaggccgctccagtaggtcacgccccagccgtaggtcgatccggcggggttccgctcgtggacggtgatgtcgtgggacgggtcctggcgcttcatcaggatcgagaagtacaggcttgcgggtccgccgccgacgcacgcgatcttcacgcgcactcccctatgttacgcaaagcggtcaattgaccacgaagggtagcagcgccatcgtgcagaccgaccgtcccggcctcttccgccgcgcggcgggcgggggcggtcgtacgatcgcggcccgtcccgccgcagacgacaggagcccctgtgacgcatccgcccgccggcccggtcctggccgcactcgtctcccgggcgaccgggggccgctactggcgactggaccggccgggcgccggtctcgacgccgaggcgatgcacatcccgccgggtgcggcggccgagccgcccggtgaccgctcgcgggacgtcctcgtgatcgccctcgacgggggcggccggctccggacaccgggcggatggctggagttggcacccccggccgccgtgtggctgccccccgccgctggataccggctgcacgcgggggaggcggggctgcactgcgtgaccgtacgcccgcgccgtccggccgctcccccggccctgccgacgacgggggcgaccggagagcccgcatgcctgctgcaccaggtctgcgccgagtgcggacgtatggccacggagagcgacgcccgctactgcaatcgctgcgggaaccccctggagcggtgagggcaggcgccagttcgcgccagtctgcgcacgtgagccgcaccactcgccccgcatcgacggcaaaagatcaccgcgatggcgccgatccggggtggaacttccccctccgccgccgggtgggccacccggggcggcaagatcatcttcgttcaatcctgtatgacatgtaggtaattgtccggatcgtagccaaccggttttcgtcgatttctccggctcccgaccgggcggataggcatgccgagtcgtcaacacacctcgactcagaaggacttcgcatgcccgaactcacccgccgtcatgccctcggggccgccgccgccctggcggccgtggccggcactcaggcccttgccgctccgtccgcgtccgcggccgggcaccacgggggtccccagccgttcgacgaggtctatcaggggcgccgaatagagggccgcgcgaccgggggcggtcatcaccacggctccgggtacggcgtgttcatcgacgggatggaactgcacgtgatgcagaacgtcgacggcagctggatcagcgtcgtcagccactacgaccccgtggccaccccgcgcgccgccgcccgcgccgcggtcgtggagcttcagggcgcgccgctcgtccccttcaactgaccgtcccgcacgtagagttctggagtcacccgcacatgaccgtacgcaagaaccaggcgaccctgacggccgacgagaagcggcgcttcgtcgacgcgctcgtggcgctcaagcgcagtggccgctacgacgagttcgtcacgacccacaacgccttcatcatgggcgacaccgacagcggcgaacgcacgggccatcgttcgccttccttcctgccctggcaccgcagatttttgatcgagttcgagcaggcgctccaggcggtcgacccgtcggtcgcgctgccgtactgggactggagcaccgaccgcacggcgcgtgcctccctgtgggcgcccgacttcctcggcggcagcggacgcagcctggacggccgggtgatggacgggccgttcgcggcgtccaccggcaactggccggtcaacgtgcgggtcgacagccgtacgtatctgcggcgcacgctcggcggcggcgggcgcgagctgccgacccgggcggaggtcgactccgtgctcgcgatgtccacgtacgacatggccccgtggaacagcgcgtcggacgggttccgcaaccatctcgagggctggcgcggtgtgaacctgcacaaccgcgtccacgtctgggtcggcggccagatggccaccggggtctcccccaacgacccggtcttctggctccaccacgcctacatcgacaggctctgggcccagtggcagagccgccacccgggctccggttatgtgccgacgggcggcacgccgaacgtcgtcgacctgaacgagaccatgaagccgtggaacgacgtacgccccgcggacctgctggaccacaccgcgcactacacgttcgacaccgtctgacggccgaggcgctcgaggtcccggcggccactcgtgggaggccgccggggtcgtgatccagggccggcggatcaggcgggcgggaaaagccgcacggcctgtcagcccccgcgtccttgggcatgctccgccggggaggtcctagacgtcgtcggcggtacggcactccgggtggccccagccctgcgcgttcttggcgatgggctcgcccgccgcgtaggggcggccgcagacacagcggccggggaacttcgccttgatcgtgcgcgtgctcgtcttggcggtgcgcgcggaggcacgcttcttggcgggagcgccgcgacccgcggagccggccgcgacggtgtcgggcgacttcggcggctccggggagccgtactcgctgcccgccggttcctggacgatcgccgcctggctggcggcacggtcggcgaagtcgttgagccggtcgccgtcgacctggtgcgcggggacgtaacggaactcgacggagcgtccgtcgagcagttcgtcgatgcgggcgaccagttcctggttggcgaccggcttccccgcggccgtcttccagcccttgcgcttccagccgggcagccaggtcgtgacggccttcatcgcgtactgggagtccatccggatctccagcgggacgtccggatccatcgcgctcaacaagcgctccagcgcggtgagttcggccacgttgttcgtggccgtgccgagcgccccggccgcccagcgggtcggggtctcctcgccgtcggcgacgacccaggcccatccggccggtccggggtttcccttcgacgccccgtcacaggcggccaccacacgttcagacatgcccccgatcatgccacgctccgccgggcgctccgggcccgggtccgacgccgccgacgccctccaggaggggctggcccccagcacgatcaccgtgcgtcgggacgtggacgaaggtcgcgccgcacggggtggtccacctggaggggcggaggtttcggccagaccttgcctggttcgacggtgttcacgcacgctacggggacctagcgtcacgatcatgaaaccgttgaccggcagcaccaccgaccaggcaccggccgatccggccgccaccgacgacgtgttggccacccagcccatcggctactggagcggtctggcccacacggcggtcacccggcagctgcgggacgccatggccaggatcgacgtcacacagccgcagtactgggtgctcaaccgcgtgcacggcgggcccgcggcgccgggccgggaggaggtggtcacccagctgacgcccctcgcggacgggccgcacgagatcgcgcgggtcgtcgaccagctgcttcaccggggctggcttcggatcgacgccggacagcgcctgcgtctcaccgacaccggggaggctgccaggaagcggctgcgtgagctggtgaccgagctgcgcgcggtggtccacgagggcatcagcgacgaggagtacgtgaccgcgctcaaggtgctgcgcacgatgatcgccaacgtcgagggcgatgcgggctgctaggccagggcggcggagggacgcgggcgctgccccggccgcaggacggccgggccttcgtgtcgtggtcctggcgctgccgtcaggacacgtcggtcagcttgggcagctcgccctgggtggtcttgatgtcgatgacggcgaaggacgcgccctgcgggtcgctcagcgccgcgaaacggccgaacgggctgtccatcggtccgaaccgcaggatgccaccgtgctcggtcgccttcgcgacggccgcgtcgacgtcctcgaccgtgaagtagacgttgatgaaggacggaacctcgggcgggaagtcgtccgtcatcttcatccggccgaggaccgcgtcctcgccgacgctgaagatcctgaagtcgaccgcctcgtcctcgatctgctgggcggtgagcgggaagacggccgggaagaacgcgtcgggcttctcgggctcacgggtgaagacctcggcccagcagtacgcgcccggcacggccgtcgcctcgaagcccttgtggacgccgggctgccagacgccgaagacggcaccgctcggctcacgggccagggccatggtgccgaaatcgccgacctgcatcggctccatcagcacctcacccccgttgtcccggatctttcgggcggtcgcggcggcgtcgggagacgcgaagtacaggcaccaggcggagtgcccctcctgtccgggcatgggcggtacgacggcggcgaccgccttcccgtcggcgtacgcctgtgtgtagttgccgtactcggacgacgactcgccgaacgtccagccgagcacatcgccgtagaaggtcttggccccctcgacatcgctgaacatcgcgtcggcccaacagggctttccctcggggtatacggccatgatccgtgcccttccgtggcgtctccggttcgacgtgcgggtgcggttcctcacgctagccaggcatcggccgggccgcgcgccgaacggcccgagccggaccacactgggacggggcgatcgtcgacgggacggggtacgggcgatgtgggcatgggaagtggagcggccgggtccgatcgaggacggtccgctgcggttcgtggagcggccggtcccggtaccgggacccggtgagctgctcgtgcgggtgcgcgcctgcggggtgtgccgtaccgacctgcacgtcagcgagggcgacctgccggtgcaccggccccgggtgacacccgggcacgaggtcgtgggcgtggtggcgggacggggcgcggacgccggcggctacgcggtcggggaccgggtgggggtggcctggctgcgccgtacggacggcacctgccggtactgcgtgcgcggggccgagaacctctgtccggcgtccgagtacaccggatgggacacggacggcggctacgccgagtacacgaccgtcccggccgcgttcgcgtaccggctgcccaccgacgtcgacgacgtggcgctggcgccgctgctgtgcgcgggcatcatcggctaccgggcgctggtgcgggcgtcgctgccaccgggcgggcgactcggtctgtacgggttcggcggcagtgcccacctgtgcgcacaggtcgcgctcgcacagggcgccaccgtgcacgtactgacccgggacccggcctcgcagcggctcgcgctcgccctcggggccgcctcggcgggcggggcgtacgacaccccgccggagccgctggacagcgcgatcctgttcgcgccggccggcggtctggtgccggtcgcgctgcgggccctggaccgcggcggggtgctgtcggtcgccggcatccatctgagcgacaccccgccgctgtgctacgaacgcgagctgttctacgagaaggagctgcgcagcgtcacctcgaacacgcgcgcggacggccgggagttcctggagctggcggcccggtacggggtccgggccacgacgcacacctatcccttgtccgaggcgcagcaggccctgcgggatctgaaggcgggccgcttcgacggggcggccgtcctggtcaacgacgtctgaacggcaccgggccgcgcaggtgcggctccggcctgcgcgtgcgtggatggatccaggcgtgtggtggcggaggtggcccgcgatggacgacgtggacagtgcgaacgcgccgtccggcgcgttcgacgccgtcgaagcgatcggcaccaccctcgacgagcgcaccacgtgcgcggaactcgccacgtacgtgtgccggaagacgggcgaggccgccgcggtggacctgctgcccgtcgacgttccggccgcgccgcccatgccgcacgcgccgcagccggccctgacccgggtggccaccgcgggccggagcgggctgctggcgtcgtggggcgtcgagggcccgcggccgctggccgtgcgggcgctggacgaggggcatccgatcaccgcctcgatggatctgtccggccgtgtcccccggcaggtgatgacggtgccgctgctggcccacggccgtctctacggggtgctgctcgtggtccggcagggtccggcgttcacggaccgggacacggcggtcacgcacttcgcggcccgcctcgccgccgtccacctggggcacgcccggcagcacgggaccgtccgcagcacggcgctcgacctgcagcgggccctgctggccgagccgggccggccgcatccgaacctctccctggcgacccgctatctgcccgcgggaggcggggccctcgtcggcggggactggttcgagaccatccggctgcactacgggcggacgctgctggtgatgggcgacgtcatgggccacggcctggaggcagcggtggacatgaacgcctaccgttcgatgctgcgctacgtcgcctcgaccgacctgccgccccaccgggtgctgcgccggctggacgcggcggtggccgaggacggcatccgccgcccggccacctgtctgctggtgcgggtcgacccggcgcgcgggtcggtcgcgctggccagtgccgggcacctgccgcccgtcgtgttcagcggggacggcaccggcgaactcctcgacgtgcccgtcggccctccgctggccacgggagtgggtggctacgagccggcgacgcggcctctggcggccgacgagaccctggtgatgttcaccgacgggctggtggagcggcgcagagaggacatcgacgtgtccctcgcacggctggccggactgcggctgccgcccggcgcggtcgtcgaggagatcctctcccggctcctcgcacacctcgacgcccggaacgccgaggacgacgtcgccgtactggccgcgcgcatccgccgacggcccatggtgaaccgggacgctcacgcaggctgaccggacccggcccgggacctggctgaaggacccggccgaagaggtgcctcgccccaccgaccggatgacatctcctggccgacgtatgccttccgcccgtcgccctcctgtgcttgcctggggaaccctttcggcggtcggggcgggagttgctgcatgcggaagccgtggatcgtggggatagtgctgggcgtgctgctgctcggcgcgtgcggggatccggcgtccgggcccgagggggccccgcccgcgcccgaggtgcgggggacatcggcggccacgcgtcagggcgccgccgcctctccgagggcgagcgcgtcggtgcgggcccccaccgtgctgtacctcggcgactcgctcgcgatggagaaccagaaggtcctcggcggcctgctgcgggacgggctgcacgcgaagtacacgagcgccccctactccgggaccacgctgtgcgactacctggaaggcaccgccgtgcggtcgctggtcccggccgcggacaaggccgccgccctggtccgctcgacacaccccgacttcgtggtgcttcagttctggggcaactcctggggctacacgccgtgcatggacgggatcacctacgacgcggcccgttcgaagtacttcgcgcggtacgcggcggacgcgaagacgctgaccgagcagatcgccgcggcgggcggcgcccgacggcccaaggtggtctgggtgttgcagggccccgacccgatcacccccgaccgcgtccgccgtgtgaacgcgctctacgaggagcgcgcccgcacctcggacggcctcgtcgccgacgcggggaaggcggtgagcccggccaccggccgctacacctggtcgcagtacctgccgtgcacggcgtacgaacacgcccacgcggcgtactgcacccagccgggacgcgaccgtaccgccctccaccgcgacgacgactacctgcacttctgtctggcgcccacgacgtccacaccgaaaccctgtccggcccgctcccccggcatcctgcgcatcgcccgcgcgatcgcccgggcgatcggagcgcacctgggctgacggcgcgcgtccagcggtgcgcgggcgcgggtgccgcggtgcgcgcgagacggggtgcgcgcgagacggggacccaccgcgcgcctttcgtccctccaggccctgttgacatcaccaggcagttctttagcgtggagcctcgcacagcatgtcgcacgacattcgatatatcgaacaagggcggggggtggagggacaccgctgccccgtctcttcgacatgcggaggattccgtgaacccatccctcggcagacggcacttcctcgccgccaccggtacggccgcggcggcagcgaccgtggccaccggtggcgccggcgcagcacacgccgccaccggagccgccccgaccaccgccggcaccggcaccgacaccgacaccggcaccggcaccggcaccggcacgcgccccttcccgctcggcgcggtgactctcctggacggcccgttccgcgacaaccagcggcgcaactccgcctatctgcgcttcgtcgacatcgaccggctgctgcacaccttccgcaccaatgtcggcctgcccagtgacgccgagccgtgcggcggctgggaggggccgggcgtggaactgcgcggtcactccaccggccatctgctgtccggactggccctcgcccatgcgagcacgggcgaggaggcactgcgcgacaagggccgccggctcgtcgccgcgctcgccgagtgccagtcggcggcgcccgcggccggcttcggcacgggctatctgtccgcgttcccggagagcttcttcgaccggctggaggcgggcagcggcgtctgggcgccgtactacaccatccacaagatcatggccgggctcgtcgagcagtaccggctggtcggcgtcggccaggccctggaggtcgtgctccggcaggcgcggtgggtcgacgagcggaccgcgaaactgtcgtacgagcagatgcagcgcgtgctggagacggagttcggcggcatgaacgacgtgctcgccgacctgcacgccctcaccggtgacccccgatggctcgatgtcgccgagcgcttcacccacgcccgcgtcttcgatccgctggccgggaaccaggacaaactggcgggactgcacgccaacacccagataccgaagatggtcggcgcgctgcggctgtgggaggagggccgggcggaccgctaccgcaccgtcgcggagaacttctggcagatcgtcaccgatcaccacacctatgtcatcgggggcaacagcaacggcgaggcgttccacgaaccggacgtcatagcgggccagttgtccgacaacacctgcgagaactgcaacagctacaacatgctcaaactgacccggctgctgcacttccacgcgccggaccggaccgacctgctcgactactacgaacgcactctgctcaaccagatgctgggcgagcaggaccccgactccgagcacggcttcgccatctactacaccggcctggctcccggatcgttcaaacggcagccgtccttcatgggccccgacccggacgtctactcgaccgactacgacaacttctcctgcgaccacggcacgggcatggagaccccggcgaagttcgccgacacggtctactcgcacgacggccggagtctgcgggtcaacctcttcgtcccgtccgaggtcgtctggcgggcgaagggcatcagctggcggcagacgacgcgcttccccgaccggtcctccaccacgctgaccgtcagttcgggccgggccgcacaccggctcctgatccgcgtcccctcctgggccgccggtgcccgggcgacgctcaacggccgcgccctgcccgaccgtccgcagcccggctcatggctcgccctggagcgggtctggcgcaccggggaccgcgtagaggtgtccctgcccatgcgcacggccgtcgaggcgacccccgacgaccccgacgtgcaggcggtggtgcacggcccggtggtgctggccggggcgtacggcgaccgggcgaacccgtggctgccgcggctggacgtgacctccgtgcggcaggaggcgcgggaaccgctgcgcttcaccgcccgcgccgacggcgaggaggtcacgctgctgccggtcgcccgcgtgcaccaccagcactactccgtgtactggctcaccggcgaaccgccctccccgcccccggagttcgcggcctggcaccgcttcgacgagaccacgggcagcacggccgccgacgccaccgggaacggcaggacggcccggctgagcggcggcacctcctggtcggcgtccggccacgacggcggagcggtgtcgctggacggcgccgacggccatgtcgccctggccgacgacctgttggcgggtgccgccgcccactcgctcgccacctgggtccggctggacgggaaccccggtacctggagccggatcttcgacatcggcaccggcgtcaccgccaacatgttcctgaccccgctcagcggcagcggcaccctgcgatacgccatcaccgccggcggcgcgggcggcgaacagcgcatcgacgcggagccgctgcccaccgggcgctgggtgcacgtggccgtgacctacggcagtggcacggcggtcctgtacgtggacggcacggaggcgggccgcaatgtgaacgtgacggtggagccgcgccacttcggcaatcacctccgcgccggatacctcggcaggtcccagtacgccgacccgtacctcaagggcgcgctcgacgacttccgcgtgtacggcaggacactgaccgccaccgaggtcgcgtcactggcctcgtaacccgtcgactgccgccgccgtccgctactcgccctcgtacgccttctccagggcggcgatgtccagcttgcccatctccatcatggccttggacgtgcgggccgccttctcggggtccgcatcgccgatcatgccgatgagcttcgccgggacgacctgccaggacaggccgtacctgtccttcagccacccgcacggaccgccctcgccgccaccctcggtgagcctgttccagtagtggtccacctcgtcctggtcgtcgcagaagatctggaaggagacggcttcgctgaaggtgaactgcgggccgccgttcagggcgacgaacttctgtccgttggccacgaactccacgaccatgacggatccggcggggcccggtccgccttcggggtagcggccgacccggccgagccgggagttcttgaagaccgacacgtagtagtcggccgcttcctcggcctggccgtcgaaccacagacaggtggtgaatccttcggcgggcatgggtacctcctcgggcggggaacgtcttcacctctgtcgaccgatcctcgcccggaaactcatcggtcgcccgccgggcagtttctgctccccggcaatcatcgcgtgttctgccggtcggggacgtgcgggcgttcttcaggcagctgcgcgaaggggagtgcccggtggttgccccgggcgcctctgcccgcggcgaatctgctgcgggcagagaaagcggatccggcggcgctcggcggtcaagagtggagtcgagcggccacggcagccgcgccgacgacttacggaggacccatgactccactcaccacggggtggcatccagccctttcaccgcgggccgaggagggcgacaccccgccctcgcgcttcgacgaccatctggcggcacaactgctcgcccagcggatcgtgctcctggggacacaggtggacgaggtgtcggcgaaccgggtctgtgcgcagttgctgctgctgtccgccgaggactcgcgcaccgacatcagcctgtacatcaacagcccgggcgggtccgtcaccgcgggcctcgccatctacgacaccatgcggctcatccccaacgacgtgtccacgctcgccatgggcttcgccgccagcatggggcagttcctgctcagcgtcggcgcggccgggaagcggttcgcgctgccgaacgcgcggatcatgatgcaccagccgtcggcgggcatcggcgggaccaccgcggacatcgagatccaggcggagaacctggagttcacgaagaaggcgatcgagcggatcaccgcggagcacacggggcagagcgaggagaccatctcccgcgacggcgaccgggaccgctggttcacggccgagcaggccaaggagtacgggatggtcgaccgggtggtggagtcactcgacgacgtccgcccgaccgcctcgcgccgacggatggggctgtgacatgggttcgtacacgattccgaacgtcgtcgagcggaccccgcagggcgagcggtcgtacgacgtcttcagccggctgctctccgagcggatcatcttcctcggtacggagatcgacgacggagtggccaacgtcgtcatcgcgcaactcctccatctggagtcggcgaacccggagcacgagatcgcgatctacatcaactcgcccgggggatccttcacttcactgatggcgatctacgacacgatgacgttcgtgcaggccccgatctcgacgttctgcgtcgggcaggcggcctcgacggcggcggtgctgctcgcgggcggtgacccgggccggcggttcgtgctggagcacgcccgggtcctgctcggccagccggccagcggcggacgtcagggcacggtctcggacctcagtctccaggccaaggagatgatccggatccgctcccaggtggaggaggtgctctcccggcacacgcggcacgacatcgcgaccctgcgcgccgacatggaccgggacaaggtgttcaccgcgcaggaggccgtcgcgtacgggctcgccgacgaggtgctcagccggcggctcgcggtcgtctaggtcctgtcgtcaaatcccgtccgccccgcgacggcctgggccgacagggccccctgggtgtccgacggccgcgagccaccgcgcgcgggtcaggcggcgaggcacatgccgtcgtaccgcgcggtcggcgcggtgcgtccccgggccggcctcgtccgggtatggcgggtcagctcgtggtgggcgagggaaaggagatccgtcaggccgagtccgagggcctgggcggcggccgcgaggacctcggaggaggcctccttgcggccgcgctccagctccgacaggtacggcatcgagatccgggccgcgtcggccacgtccttgagcgtgcgctcctgtgcgagccgctcgcgccgcagcacgtcaccgacgaggtcgcgccacaagggctccttggccgcgggggcggccggccgctgtcccggccgctgcggggcgcggcccggggcggtgacgggaacgcgcgcggcgttcggacttcggggcggggcgctcgccgggcgcagggcgatgacgcgggcttcgttcggcgcttgattgctcaccccctcagcgtaggagtgccgcgccgaaggggaagggatcggcgttctgccctgggtgaatcccgcggtgccggcccatcgcctcggcgtccgccatggaccgagcacccgtcagggatcccgtgcgaagtcccgtacaaccctggtgacccatcgagtgtcaaacagggcgccggacaaggaacgggccctttccggacacccccgcgctgcccggccacctttctctttcaggagccgctcgtgcgcaagaaccgttcggccgccctcgccgcggcctcatttcttctgatgaccggagcgggcatcgccgccgccccgtccgcgtacgccggaacacccggcggtacgcacgcgaacgaccgcaacagcgacttcaacggcgacggttacgaggacgtgctggtcggcgctccgggagcgacggtcagcggcaagaagggcgccggtctcgtcaccgtgcagtacgggtcgtcgagaggaatcggcaccaccaacgcggcccgcttcagccagtccacggccgacgtcgcgggcgccgccgagaccggtgacgcgttcggccgggcggtcgccaccggcgacctcgacggcgacgggtacgacgacgcgatcgtcggcgtgcccggtgaggacctcggtaccaccaaggacgcgggcggtgtcgccgttctgtggggctccaagtccgggctgtcgggcgccgccagcgactggctggagacccaggagcccaccgccgacgagcagttcggcagcgcgctcgccgcggcccacttcaccgatgagacgccgggcgacctgctcgccgtactcgaccgcgacgacctggagctgttcgggtacgactccgcggcgcaggcctcgctgaagcagcggtcgcagcagcggctctcggcacgcgccgaccagcgcgacatcctgcccacgtcgctgaccaccggcgactacgacgacaacgggtacgccgacctcgtcgtgtccggcgtgaccgtgggcgacgagccggggcacggctggtcctcgctgctgacggggcacgctgacgggctgtcgtacgaacgcgatctacgaggcggaccggtcgccgcgtccggggacatcaacaacgacggctacgacgacctggtgaccggtgagccgcactcccccaacgacgtgtacggcgagacacgcacgggcggtgtggtcggcgtgcgtctcggcggcccggacgggcccgcggccgatcccgactggtggacgcaggagtcggccggcgtacccggcaccgcggaggtcggcgacggctggggcaccgacctgtcggtcgcggacaccgatggcgacgggtacgcggacgtggcgatcggcgcctccggcgaggacatcggcacggtggccgacgcgggcgccgtgtgggtgctgcgcggctcggccggcgggctcaccgcggccggggccaagtcgtgggaccagaactcggcggacgtaccgggcgtggcggagaagggcgacaaatggggcgcccaggtccggttgaccgacccgaaccgcgacggacgcttcgggctgctcgcctcggcgcccggcgagaacgccggcgacggcttcgtctgggtcctgtcggcgggcaccggcgggatcacggcttcgggctcctggacgtacggcgcggacacgctcggcgcgccctccgtggccgcggcgttcggcgcggcgatcgacgaatagccgtacggcgtgagccgttcccggcgtgacggccgtcgacggaagcccaattgcgggcgaacgggcgggcgtacaacgggcacggcggggtaaccggggtcgggagcggtcggagcgccgacccgaatcatcaacagggagacgaacgtgctgatggcccaccccgccgtgctgcgcaatctcgtggagcagtacgagaccctgcgcgccctgcacgccgagaacggcagtacggaagtgcgacagcgcatggacgacgcggcctacacgctctgcgtatcgaccggtacgaaggacgtggaggccgcgctcgtcgccgcccgccgtcgactgcccctggcacgcaccaaggaggactcgctgctcaccacgtgaccggcgacacatccaagtcgcgcgaccgttgacatgtgttcccgattccggggtaagcgcgggagcacgacgcttggacaaagcccgacaggccgaacagtgagtttcgtgggagaggtaatggacaccgccatgagcaggtcgatggtcaaggacgaggcgacccggaccgcgactggtgaggggtcgctgccacatatcgtggatccgcgtaccgtggctcctcgtgacgcgcgggagctgtcccgccagttcttccggcgcctgagcgaactcgaagagggcacacacgactaccagtacgcccgcaacaccctgatcgagatgaacatgtcgctggtgcggttcgcggcgggacgcttccgcaaccgtggggacgacatggaggacatcgtccaggtcggcatgatcggcctcatcaaggcgatcgaccggttcgagatctctcgcgaggtcgagttcacctccttcgcgctgccgtacatcgtcggcgagatcaagcgtttcttccgcgacacgacgtgggcggtccatgtgccgcgccgcctccaggagttgcgggtcgagctggccaaggcgcgcgaggaactgtcgagccggctggaccgcgagcccagcgtcgccgagctcgccaccctgatgaacctgtccgagaacgaggtcgtcgaggcccagatcgcctccaacgggtacaactcgtcgtcgctggacgccgcgctctccggggacgaccaggagggcgaagccgtcctggccgacttcatcggcgaggaggacgacggcatgcagctggtcgaggacttccacaccctcgcgcccctggtcgccgagctcagtgaccgcgaccggcagatcatccacatgaggttcgtggaggaggccacccaggcggacatcggcgcccggctcggctgctcccagatgcatgtctcccgtctgatcaagcggatcatcgagcagctgcgcacgggcatgctctccgatctgcatcgggtcgagagcgcctgacggttcctgaagtcgagagcgcctgacggttttcctgacagggcggtggcgctgccccactccggtgagtggggcagcgccaccgccctttcgacgctgtcctcagcgtcaggctttcctcagcgcagccactggtccttctccgcgggccggtagagggtcaccgccctggtccgcttgtccaggacgagccggggtgcggccgcccgggtcacctctccgtcgtacgagaaccgcgggtcgcccttcaggacttcgagccggaggccgcgcacctgcgcggtggtcagcacccgcgagttgtgcagagtcccggtgagcaccgcgagcagcagccgtgtcctggccagtggcgtgccggcgtccacggcacggacgtcgaggaggccgtcgtcgagctgggtgcggtacgtgggcgcgaagccggccgggtggtagatgccgttgcccgcgaacagcagccacaggcgcttggggcggccgttcaccgagacgctgacggggctgcccgccgcgagcacgcgcgccagtccgacgacgagggcgggccatttgccgatccgcttctccagctgctcacgggcgtgcacgaggtcggagtagacaccgagactgaaggtgttgaggaacaactgctcggggccgtcgggaacgcgggcgcagccgacgtcggcgacgatcgcgtccccgtcgcacacggcgcgtgcgacgtcctccatcgtctggtttcccaggtccacggcgaagtggttgaaggtgccgccggggaacaccgcgagcggtacaccgagccgagcggccacctccgtcgccgcgttgatcgtgccgtcgccgccgcaggcgccgagcgcgccgcccgcttccttcgcctgccgggcggcccgttcgaggagttccggcagttcctggccctcctgcggcaccaggaactcggccttgggcaggagcgagcgcaggcggcccacggcgtcgtccgcgtcggtgctccgcgagacgccggacgaggggttgacgaccacatggagtccggctccgtcggccagtgccggcgcgggcctgcggggcggcgccgcggcggccgccgtctcgggcttgaccggccaccagcgtgcggtgagcgcggcggcgccgatgccgatggcggtcccgaccgccacatcgccggggtggcgggccccggaacggatgcgggccgccgtcagggccgcggcggccggggcgacgaggagaccgtaccggggcgcttccaacacgacgcccgcggcgaacgcggcggctgacgcggcgggtcccgccgcgtgcggggcctctgcccggtgggcggtcggacgcgcgagcgtgcgggtgacggccgacgccatggccacggctccgatgccccgcatcgccgcccggcgcgccgtgcgctgcccggacacgccgagcagtgcggcggcgccgacccatacgagcccgcctccgacggtccgacgccacccggacgtcccgctccgccccgcctcgaatgcggtggcgacgcggcggccggtgccgcccccttgtcgcagccaagccgtgcgttcggaagccactgggcccaccccttgcgtatcgacggatctaccggtcggcaaggtgagcgccgcccctctccctgatgcccaggcttctccccttcatgggtgttcatgggttcacgactgtttcggcagctccatgacggccctgacgcacttcccgaccggcactcgctccacggtcaccgcggccgccagcacatggacgatctccagtccgtgcatacccacgcgtccggggtccggggggtagcgcctgggcagcgcggcgctgctgtcgtacaccgtgacggtcacggaggcgtcggtgccctccagctcgaggatgtacgggccgtggctgtgccggtcggcgttggtgaccagttcgctcaccacgagaagcaggtcgccgtcggcacgggcgtcgatgggcgcgcaccactcggaccgcagctgttcgaggaacagcgcggcgaaggcccgggcctcggcgatggaccccagttcccccgtgtagtgggccgcccgccgcagcggctccacgggcatgtcgaagtcagtaggtatcactgctccgtccaagctctcgatcatgcaggtctctctcggaagcgggtccattcctggcgcgccacacctcgtccgtacctcgttcctggggtgtcgcaccagtgctcgtacccagcgaatcgcttcgcactcaccccatgttctcccggagcgcggcgcggtgtggcccgttcagccggatcggtgcggaccagcggatgccgggccgcgtccccgccccctcgcgacagggctgcctcagtacgacggcggggtcgcggccggctccggggcactgtaggtggtgtcggactcgctggtggtctcgggcgacacgacacccggcgacggcggctcggtggtggtgggctcggtcgtcgggggctcggtcgtcgggggctcggtggtcttgcgctcggtgctctcgggctcggtggtcggaggctcggtggtcttgggctcggtggtcgggggctcggtggtcttgggctcggtcgtgggaggctcggagtacgactcgggtgacgactcgcgcgacgagttcggggacgacggaaccgatggggacgacgacgacggctccggcgacttcgaggacggggagtgcggcttcggcgaggaggagtccggcgggagcatcgaggcgctcaacgacggggacggccgatgccgcggcggatcggtcttctcgtcatgtcggcccttgtcgccgcgccggcggtggaaccattcgtcgtggtccgggtcgaacatcacgaacacgttgatggccgtcggcgcgggcgtgacgaacacgacgttctgcggccggtacgaggcccacgtgtcgcccgtctgcctgggcctggtcgtctgcgggaccgggtacaggagcgggttgccgcaggcgcagcgcacccggggcacgccgcggctgttgacgaggaccgcggtgccggcctgtagcaccgcctggtacggggtcgccacgccgttgcggaagccgtggttggtgacccaggtgtccacgcgcagttgcacgggggtgagcgaccgcagataggcagggacctcggacggcgcgatgccctccaccgaggcgaaggcacggttcttctcgggggccgcccggagcgccttgatctgcttctccacgtcgcagctggagaccttgcgggtgccgccgtagagaccgggctcggagccgtcgataccgcgcgccgcctgggcggacgccgacgtgctcgccggggccggggtcaggggggccgtggaactctcgttcgccgtggactccgtgaaggggtaggggcccgacttgccggcggcctggaggaagacctcgccgcccttgccggcggtggacgtgccgtgggagcgggtgaggacgagggcggccactacggcgaccacgacggcggtggccatcagagccacccggggtgcggacttccaccagcgttcgggctccttgcccgcgtcgcccggcccgaggggaccggacgggccgccgccaccgccggatcccgcggaccccccgctgcccgcgtcgccgcccgacgagctccggacggggcggccgctcggctggacgggccgctgctgcgtgggacccgacaacgggcccgaggggggtcctgtggggcggccggccggcggttcgacgctcacgagctcttcttccctgcgtagggatgagcggcatctcatctactttgtgccgctttgttgtagatcaatccattgtgtgctccggtcccgggccgctcgcaagccgacgcggtcggccctcccgaggggcggagcgccgacgccgtgcttagcgtgacagcgtgagcgcccccacaccgtccgaccagacagtggcccgcccgggccggtcggcgttcgcccggcacggctgggtccaggccctcgcgacggtactggccgggctgatcgtcatggtggtgaccgccgcgctcggactgttggcggcgggtgcggccggccttcccggcaacgcgttcgtgagcgtcgacgcggccaccgtggtgacggcggtcggcggcaccgtgaagctctcgggcgacgcgggggcgatcgccgacacgaaggccgggctgaccgtgatgcccctgtccgtctcgctcgccggggtgctgacgatcgccgcgggcttcctgcggcacctgcggcaccgggccgtcgccggcgcgcgcgaactcgccggctggtccgcccgcatcgccgtcgtgtggctggtggcgctcgtcggcctcacgttcacggcccgtcacacgttcacgatctccctggggaacgggatgatcggcgacatcggcgagctcttcggcgtcgctccgaaggtcggcttcaccacggacgtacccctcaccctgctcttcggactgctgtggctggtgggtgtgttcgtcctcgccctgctggtgtcgcgcggtgcgccgctgccggcccgggtcgtgcgcttccaggagtcggtgcgtccggcggcgtacgcgatggtcgtgctgctgctcgcgtatgtcgtcctggggatcgtgatcgggctggtcgtggcggcgagccgcgggcacaccgccgagacgttcgcggtgattctgctggggatgccgaacctggtgtggctcgccctcacgatcggtctgggtgccacctggaacggccgggtggacgggccgttcggtctgcccatgccgcatctgctcgacgaggtcctgcgcacgccggacgtcgccacgctcgatctgcgctcgctcgcccactacgacggccgggtgtggtggctggtcgtcgtcgacgccgtgctgatcctggcggccgcgttcgtgatggcggtgcggtcaccggcgcggatacgggcctggcagcacgccctgcacatggcggtcgcgctgacgctgacggtgctcatgatctgtctcgtcgcccgcgtctacgcccatttcggcctctcgctcctcggcatcggagatatcgacggcggcctgtccggagtgctgttcctgaagcccaggctctggaccgcgctcggctgggccgtgctgtgggggctggtcaccggcttcctcggcgcgctgctcgccaggcccgtgcaccggcgaggcgaagtcgcctgagcggcccggccctaccggatgcacccgacggccgcctgacacaattcgaacagcactggcgtacggcagaacctgccgcggacgatggaggggccctgtgccgccgacctcacgacccttgcggaagctgggcttcttgaccatcggcctgttcgacggggccgaccccggccgaggccacgagtcgaccctcgggatcatcgaactgggcgagcaactcggcttcgacagcgcgtgggtgcgccaccgtcatctgcagtacggcatctcctctcccgtcgcggtgctggcggcggcctcgcagcgcaccaggcgcatcgaactgggcacggccgtcatccccctgggctgggagaacccgctgcggctcgcggaggacctcgcgacggtcgacatcctcttgggcggccgcctcaacccgggtgtcagtgtcggccccccgatgcactacgaccaggtcaaagaggcgctctaccccgacaccgcggacgccgaggacttcggctacgagcgggtacggcggctgctggacctcgtacgcggcgagccggccaccgacttcagcggcgtcgagggcttcgaggtgttctccgaccgcgtccagccccactcacccggtctgggccgccgcatgtggtacggcggcgggagtctgcggtcggcgcagtgggccggtgagcacgggatgaacttcctcaccagcagtgtcgtgaaggcggaggagtccgaggacttcgccggcatccagctctcgcacatccgcgccttccgcgcccatcaccccgacggcgaccgcgcccgtgtctcccaggggctcgtcgtcatccccacggactccgcctcgccggagcagcgcgcgaagtacacggcgtacgtcgagaagcggactccgcgcaccgtcacgccgcagggaccggcacgcatgatgttcgcgcccgacatcgtcggcacctccgccgagatcgccgaacggctccacgcccacgcggccttccaggaggtggacgaggtcgcgttcgcgctgccgttctccttcgaacacgccgactacgtgcagatcctcactgacatcgccacccggctgggcccggcactcggctggcaggcggccacctgagcctgccccctagcggcggaaaaccggccgggcccagcgcggtggttcggggatcgtggtgggaccggtccgcttcggcgggtgtctttgcgggccggcgcctgcccccgcggtacgcagcgcggccacgaacgcgaggcacgagtcgtagcggtcctcggggctcttggcgagcgccttggccatcacctcgtcgacctgcgggcccaggtcggggcgcctgcggctcaggcgtggcggctcgtcgtgctggtgggcccacagcagcgccatctcgtcgtcgcgacagaacggcggcgtcccggccaggatctcgtagacgacgcacccgaagccgtagacgtcgcagcggccgtccaccggcttcccgcagatctgttccggcgcgacgtagtccagcgtgcccacgaactggcccgggatcgtgaacccggtcaccgtcagcgacctcttggtcaggccgaagtccgtgagatacacatgctcgggatggtcgctgtccgtgccccgggccaccaggatgttgccgggtttgacgtcccggtgcaccagtccgtggtcgtgcgcggcgtccagcgcggaggccacctggagggcgatacggacgccggccgagaacggcaacgggccctcccggtcgagcagatgacgcagatcgcgccctgagacgaagcgcatggcgatgtacaggacgccctccgtctcgcccgcctcgaagaccggcacgatgttcggatggtcgatggcggcggccacccgcgactcgtgtgtgaaccgccggcggaaggtgtcgttgagcgccagctcgggcgcgagcagcttcagcgcgacggtccggtccagccgcaggtccctggcgcggtagacgacggccatgccgccgcgggcgatctcgcgttcgatgcggtagctcgcgatctgcttgccgatcagctcggagggccgctccgaggacaggcccgtgccgtgcgacgggccggccatcagaggtcgtccgtgtcgtcggggaagtaccgggcgaggccgtccgcggaccgggagccgtccgggacggcgtcctggacgacgcgggtcggctccgccgggaccgggcccggcgtgtcgccctcggcggcgtacgtgctcagccgggtgccgtcgcagtactcccaccgctcgtgctcggcgtcgtacagccacatcgactccccgtcgacgaccaccccgatccgcagcccgtgggtaaggctgcgaaagctctccccgtccaggcttccgcccgccagttcctccgccgcgccgcgatagcggccgagcgcctcttcgacgtgggcgagcagggggcgcgggtcctccgcgcgaacgggagagccgggcgcggcgggcggtggctgcggcacgctgaccaggagccggccgtcgacccacgccgaccagccgttggcgcacaccacgtgcccccagtcgccgcgccggtcgacgagctggacgggcagcagcgcgtcgagcggcacggtgggccgggcgacgtccggggcctcccaggcgggcatcccgtcctgggggacgacgtgggtcgggcggaatccgggggcagtcatcgccgctacttccgcatgaccaggggttcgtgccggcgcaacagccggtccaccgcgtacccgaagacgagggacagcacgacgagcatccccatgtcgagcagccacacgcccgccgagcgtctgaacagcgggtctccggtgaggtcgccgggcacgatccgggcgagtccgatcgtgcccgccatggcgcccagcgcccaccgcgagggcaccagccaggacagctgctggatcaccgccaccccgttgagcttcagcagggcaccgcagaagaccacttggacgatcgcgaggagtaccaggagcggcatggtgacctcctcccttcgcaccagggccgagacgaggaggcccagcatcatcgcggtgaaggagagcagggcgacggcgagggtgagctccacgagcggtggcatgaggacgccctcgccgccgggcgcgtcgaggtcgacgccgagcagggcgaccagggtgagcacaatggcctggagcacggtgatcgtgccgaggacgaccaccttggacatcaggtacgccgacctggacagcccgacggcccgctcccgctgatggatcgcgcgctccttgaccagctcgcgcacggcgttggccgcgccggtcagcacgccgccgacgcacaggatgagcagcgcgttcatggcggtctcctgggtcagtttcccgccggccagcgcccgggccatggcgcccatcacgaacggcagcgcgatcatgatggcgaggaacgtgcggtcggcggagagcgtggccgcgtagcgccgtacgagcgtgccgagctgggcgccccagctctgcgccttcggcggcggtccgacggctgccgccggggcggccgacggcaggtagggcggtgtgccgacgccctcgatgtactgctcgtgctggagtgagtcgcggtattcccccgcccagtcccggtcgcggtcgtgttcgaaggcctcgaacgcttccggccactggacgaagccgaagaagggcagggtctcgtccggtggaccgtagtaggcgacggtgccgcccggggcgaggacgagcagccggtcgcagacgtccaggctgagcacgctgtgcgtgacgacgatgacggtgcggccgtcgtcggcgaggccgcgcagcatatgcatcaccgaccggtccatgcccgggtcgagcccggaggtgggctcgtcgaggaagagcagtgacggcttggtgagcagttcgagggcgacgctgacccttttgcgctggccgccggagaggctgtggatgggctggtcggcacgttgttccaggcccagctcgcggatcacctcgtcgacccgcgccctgcgttccgccttctcggtgtcctgtgggaagcgcagctcggcggcgtacccgagggccctgtgcacggtcagctgggcgtgcaggatgtcgtcctgcgggacgagtccgatgcgccggcgcagctcggcgtagtcgcggtagaggtcgcggccgtcgtacaggaccgtgccccggtcggcgggacgctgcccggtcagggcgttcagcagggtggacttgccggagccgctggggccgatgacggcgagcaggcatttctcaccgaccgggaaggagacctggtcgaggaggatcttgtggtcgtggtcgagctcgacggtgaggtcgcggacgtcgagggagacctcgccggtgtcgacgtactcctgcaactggtcgccgacgaggcagaacacggagtggccgatcccgacgatgtcaccgggcgtgaccggggcgcgggtgacgggctggccgttgaggtaggtgccgttgtggctgccgaggtcgacgatctcgtatgtgccgtccggcagcgcctgtagttccgcgtgccggtgggagaccatgaggtcgtcgatgtccaggtcgttgccgccgccgcggccgatacggaccgtgcgggtgggcagcggccgtacggtcgtcggctgccggaacgtgccggtggcggagggcatgaagacggcggagggatgctcggttgcgagccgcgcgcagtcgacgaggacggcgcgcgggccgtcggaggggttcccgaagcggatctcgctgcccggtccgacgccccactcgtggatgcggcggccgtcggcgtaggtgccgttggtgctgtgctcgtcctcgagcgtccagtggtcggcctcgacgctcagcaccgcgtggtgccacgagacccggacgtcgtccaggacgatgtcgctcgaggggtcgcgtccgacgtgatagtcgcggctcgggctcatcaccgtggagcccgtctcggtctcgaggacgagctcgggtgcagtcggcgcgaccggccgctctcccatgtgctgaattctagctattcgcccacatgtgcgcctgatcggcgagccgcgacgggggcgggcccgtcaggccgcgggggtggagagcgcgggcacgaaccgctgcatccgcagcgcgtccacggactccgccaacagctcgtactcggtggtgtcgtcgctggtggcgatgcggacgagccggcctgcggccaattcgtccgcgaccagctcctgctggatcgcgtcgccgcaccatgcccgcagcaggctcggcacgtcggggacggtctccgcgacgggggcgatggagttcggcgggaagttcgggttgtcggggtggggatcgagccgctcggcgatccatgaggcacggtcacgcatccaccacagggccagcgccagggtgggcgcgcgatacgtccccaggggcactccgacgcgctgaccgccgcatatgccgtacgcggtgacatggcacaggaattcgtcgtgcacgatcgctcccccattgcggcgctcgctgccgggtcggccctctttccttgcattcgctcgctgtgcacatgggacaggccggcgatgacgcgcgaggcgcacgaaggcgcgattcgatcgtggccgaattgccctaggaatcgagtatcgccactactgacactctgtcaccatgccattccagccagtctcctggcatattcacggtccggtttggccgaaatgagacgagcgccgcagtgaaggcggggcgtacgcccggcgcgctggcacccttacctctgaggtaatcgacgccgtccgccccggtcccgcatggttgcgatgtcggatccccaccgcaccaagctccggggatccggcctctgaccagcatgtacgcaactgccgacgccgatggaggccgatccgcatgagcacgaacagcaaccgctacgagtccgccgtcgcccgctacttcgaggcctggaacgcgggtgaccaggacgcgctcaccaaggcggtcgccgccgcctggaccgaggacgggagctacaccgacccgctggccgatgtcaggggccacgagcagatcacggccgtgatcgcggcggcgcacgagcagttcccggggttcgccttccggctcaccggcacggtcgacgggcaccacgacatcgcccgcttcgcctgggagctggtgaacgaggcggacggctcggcacccgtcgccgggtccgacgtgatcaccctggacggcgaggaccgcatccggagcgtgcaggggttcctggaccgcgtgccggccggagccgcctgagccagctgcgccgtcctgaccgcgcgtggtcgtcgagccggccggcccggccccggccggctcgacgaggagcgcctggaccgtcagggcctcggcttgatgatcgcctcgatccgggccagttcctccgcgtcgaagtccagcgtgcgggtggccgccacgctgtcctccacctgccgggcgctgctcgcaccgatgagggcggaggtgacccggccgccgcgcaggacccaggccagggcgagctgggcgagggtctggccgcgggacttggcgatgtcgtcgagggcgcgcagctgtcgtacgagatcctcggtgaccgtgtccgcgctgaggaacgggctgtcgctcgcggcgcgcgagtcctccgggatgccgtcgaggtagcggccggtcagcaggccctgctccagcggggagtaggcgatggagccgatctgcagttcgtcgagggtgtccaggaggccttcctcgggacggcggtcgagcatcgagtagcgcggctggtggatgaggagcggggtgcccagttcgccgaggatgcgggcggcctcccgggtctgctccggcgagtagttggagacgccggcgtacagcgccttgccctgctggaccgccgagtgcagggcgcccatcgtctcctccagaggagtctccgggtcggggcggtgcgagtagaagatgtcgacgtggtccaggcccattcgggtgaggctctggtcgagcgaggagagcaggtacttgcgcgagccccactcgccgtacgggcccggccacatcagatggccggccttggtcgagatgaccagctcgtcgcggtagggcgcgaagtccgccctcagggcgtcaccgagggccgactcggcggcaccgggcggcggaccgtagttgttggccaggtcgaagtgcgtgatgccgaggtcgaaggcgcggcgcaggatctgccgctgggtctccaccggccggtcggggccgaagttgtgccacaggccgagcgacagcgcggggagcttcagaccgctgcgtccggtgcggcggtacggcatggcctcatatcgggcggaatctgcggtgtacaacgtgcactccaggagggcggcttcgtgggaacgtccgcgtgcgggcgaacgtccgtgtagagacgtcgtccactctcacctgcctcgcgggcatcggtccaacagaagaatcggatgagattcagcgtctagacttctcaatcatggaactgcgccaccttcagcatttcgtcgccgtcgccgaggaccagcacttcacccgggcagccgaacggctgatggtgtcgcagtcggggctgtccgcctcgatccgcgccctggagcgggagctccaggccccgctgttcgtccgcaccacccgcagtgtcacgctcaccgaggccggccgcgcgctgctgggcgaggcggagcggatcctggcccaggtccgggcggctcacgacgcggtggcggccgtgcagggcgtgctgcgcggcacgctctcgctgggcaccgagcagtgcatcgccggggtgcatgtggcccggctgctcgccgggttccggcggcagcatccggatgtggagatccggttgcgccaggcgggctcgggtgcgctggcggaggaagtcgccgccgggcgtctcgatctggccttcgcggtccggacggagacggacaccgaccagttgcgctccgtgccactgaccggcgagccgatgaccgtgctctgccacccgacccacccgctcgcgacggccggcgcggtcatgccggaggacctgggcggtgaggcgttcgtcgacttccacccggactgggggccgcgccgcatcaccgacgccgccttcgccgccgcgggcgtgaggaggaccgtcgcgctggaggtcaatgatgtgcacagcctgctcgacctggtcgaggagggtctcggcgtcgccgtggtgccccggcacttccggcacaagcgtgaggcgctcacggctcttccgctgaagggcacgggcgagacggtgtacgagaccgtcgccatccttcctccctccgcggccaccagtccggcggcccgggcgctgatgaccttgctggaagaggagttctagcgcacctggagaggtgccgagaggggtcccaccgctcccgaccgggccgtcgtgccgccgcggactcgcgagcgtccggcacacgaaccgcgttcaggagtgggcagcgcatcgccgcccaggcgtgaggggcagcgatgcgcgagggtggacccatgcacgcaaaggacgtcctcaccgacgcgtacagccgcatccaggaagaagtgcacgccgccgtcgagggcctggcgcctgacgtcctcaacgcccggcccgccgacgacgccaactccatctcatggctcgtctggcatctcacccgtgtccaggacgaccacctggccgatgcctcagggctcgaccaggtctggccggcccagggctgggacaagcgcttcggactcgacctgccccgccgggacacgggatacggccacagcccccggcaggtggcgaaggtgcgggtggactcgggcgagctcctgctcgggtactacgacgccgtgcacgaacagtcgctggagttcatccgcgggctcaccgccaaggacctggagcgtgtcgtggacgagcgctggacgccggccgtcacgctgggcgcacggctcgtgagcgtcctggccgacgatctgcaacacgtcggccaggccgcctacgtacgagggctccttcagagcgcggcctcgtagccgggaagcactacgtcctggatgagggcgttgcgctcgtcgaaggggaggaacgcgctcttgagggcgttcaccgtgaccgtgcgcagatcgtccgtgctccagcccgcctcctcgaccagcagggacatctcacgggtcatcgtcgtgcccgacaccagacggttgtcggtgttgagggtgacgcggaagccgaggtccttcagggccgtgatggggtgctcggcgatcgacgtggcggcgcccgtctggaggttggaggtcgggcacatctccagggcgacgcggcgatcgcgcacccagcccgcgagccggccgagcttgccgtcgacgatgtcctcggtgatgcgcacgccgtggccgatgcgctgggcgccgcacacctggagggcctggtggatgctgggcagaccgtgcgcctcaccggcgtggatggtgaaggggacgttctcccggcgcaggtgctcgaaggcgtccaggtggtcggcgggcgggaaaccgtcctcggcacccgcgatgtcgaagccgacaacacccgcgtcgcggaaggcgacggccaggtcggcggtctcccgggtgcggtcgaacatacgcatcccgcacagcagtgtgcccacccggaccggggtgcccgcggccgccgccttggccatgcccgccgccaggccctcctgcacggtctcgacgacctcggacagggtcagcccgcccttcagcatcagctcgggggcgtagcgcacctcgccgtagacgacaccgtcggcggccaggtccaggacgtactcctcggcggtgcgcagcaggccttcacgggtctgcatcacggcgagggtgtgctcgaaggtcgctatgtagcgcaccaggtcaccggagttggcggcctcgtagtaccagtcggccagcgcctgcgggtccgtggtgggcagtgtgtggccgaccgcctgtgccagctccaccagggtggcggggcgcagaccgccgtcgaggtggtcgtgcagcacggccttggggagccggcggatggtgtcgatgtcgagcgcggtcatgcggtgtcttcctcggcaggttcttcagtgagcggtgggggcgggcgcgggctggagcaggtcccagcggtttccgtacaggtcctggaagacggcgaccgcgccgtacggctcgtaccgcggctcttccaggaaggccacgcccgcggcgcgcatccgtgcgtggtcgcgggcgaagtcgtcggtgtgcaggaagaagccgacgcgtccgccggtctggtcgccgatccggccgcgctgcgcgtcgcccttggcgcgggcgagcagcagtccggtgccggcggccgccgatcccggctcgacgacgacccagcgggagccgtcgggccgcgactcgtcctccgcgaggcggaacccgagggcctcggtgtagaagcggatcgcctcgtcgtagtcgtcgacaacgagggtcaccagggcgatgcgtctcatcgggcctctccgaccgtccagggttatacgtaacacgtagcgtacgtcatcgatcgaggtgactttgtgtccggtgggtcacatgcgccggactgacgctgccccggcccccggagacccgggtaccggggcagtcttcatgccggagccgccgccgcggagatcagtcccgctcctcaccttgcgcgacctcgacctgatggtggaagccgatgactcccgtcgccgaggcacagacggacagggccgcgcaggcgaccagcagggcggccatccggcgcgctgcgcgacggggcgggcgcggcaccgacagcagggccgcaacccgctgcggcacgggacccgtggccaccgcgggcgcgaacgaggggcggtcgctgtgggcggcccgcacggccagggcggcccggccgatcgcccgggcggtcagccgccggtccccgacggccgcggcgtgcggcctcgtcggccacccgctccaccgcgagccggatggcgtcgccggcggcgcgcagtcccgggtggcagtgcgcggcgagttcggcggcgacgaggaagtagtggtggccgcccgcgttgtgggcccgctcgtgcgcgaacagcgcctcgcgctcgtccgggccgagactgcggagcatcccggtggtgacgacgatccggtgcggcctgcccggcagggcgtacgcgtccggctggggcgagtcgatgacgcacaggtcgcccgcggtgtgccggtcgtcggccgcactggtcgccgcccggaaggcacgggactgccgcacgaccgtacggaccagcgtccacagacagacggcgagggcgccgacggagaaggcggccgccggtacgacgaacatgttcgacgccgtgcgcagggggtgcaccagctcgccgagggccgcgaacagggggacttcgagcaggccggtcaggacgaacgcgccgagcgcgaccagggaactgcccgcgagcacgaccgcggagcaggtcagcatccacagcgcggccgtgggcgcgagacggtcgagcgcccgccgggccagtacgggcatcgcgaagggcagcgcgaccgggatcaacagcaggaggatcactgttcaccggattccagcaggtcccgcaggactcgctcgtcgtcttcgctgagctgggcgacgaaccgcgcgagggcggtgtgccggtcgctgtcccggtcgagctcggtgtgcatacgccgggcggtcaggcccggggcgtcctgaacggggaagtaggcgtagccgcggccatggcgctcgcgtccgacgatgcccttctcatgcagccgggagaggatcgtggtcaccgtcgtacgagccagccccgcgccgaggccgagctgcacctgccccggggtccggggcacgcccgcggcccacagcgcggccatgacggtggcttcgagttcgcccgccggtcggcgttcgtccttcgcttcggccatgggaaccttcctcgccctgcaatcgtctacagtgttgtagaccgtgtacggattgtaatcgtcgcgggcccggtcccggctgtgcccgcacgcccgtttcgactgtgcccgcacgaccattatggaaggggcccacgaggatgaccgccgccctgtacatctcgccgttccgcgcggtcggtgctcccggggtgccgtcatgaagcgcgaggacgcctccgacctcgccggctcgacggcggtgggcgcgctggtggccttcgtactgctggcgctcaccgtgtccggccgggcgggcgacccgctgttcggggacgcggacctgttcgactggtcggtcacccatcgccccccggtcgccgtcgcagtggcacgtgcagtgacgtacacgggcacgggcttcattccctacgcactggtcgtcctggccgggctcctggtgggccgcacggcgcggcagcggctcttctccgtcgccgccgcgctcctctgcctggccgccggccaggccgtccggtacggcgtgatgtccctgatcgcccgcccgcggcccgcgacggcgggctggtccacgcatgcctccggctggtccttcccgtccggtcacaccacgacgtccgcgatcaccgcggggctgctcgttctcgcggtcctggcgcgcgccccgcgcggcagaggtccgctcgccgtggccatcggctgctggggtgttctggtcggactcacccgcgtctatctgggcgtccactggttctcggacgtcctgggcggctggctgttcgccctgtgctggctgagcctgagcgcctacgtcgtcacccgcatcgctcctcccgtcctccacgagatagcggcctcccgtcaccgcccaggtcctacgacggaagagcgccgccatgactcccccaccagcaccgaagaccccctcgaccctgctccgccgccatctcggacgggccgtcggcgcggcctatctcgccgccgcgaccgcgccgggaccagggatgtggctgcgtcatccgcaccggatcgccgtcgtcggccttcctgacttatccctgaacacggccccgttcctgctgtcgctcgtcctgttcactgccggactgcaggtccccccgcgggatctcggtcggctggtcggacgaccggccgccctgctgaccggtctcgcgctgcatctgctcgcgccgctgctcatcgtgccgggggtggcgttcgccctgcgccagtcccccgacagcgacggcggcagcgggctggtcgccgcgatgatcctggtcgtcgcgatgcccgtggccgccggggccacggtgtggacgggcgcgggcgaaggagaccagtccacgaccgtcgggctcgtgctcgcgtccacgctcgccagtccgctgaccgtcccgttcaccgtgacggccctgtgtcccctgctcagcgccgactacgcggacaccctggccggggcggcccgcatcgcggggagcgggttcgcgctcacgggagtcgtgctgccctgcgccgccggtctggtggcccggctcgccctgccccgccgcgccctggacgcactcctgcacgcggcggtccccacggcggccttgggctcgctcctgctgacgtacgtcaacgccagcggcgtactcggccccttcctcacccggccccggccggtcctgctcgcggcggcgctggccgtcgccgcgacggtgtgcgggctgtccttcgccctgggccggatcacggcccgcgtactgcgcctcgacgcccacgccggggcctcggtgacgctcgcctgcgggatgaacaacagcagcgcgagcgccgtgctgatcacgacggcgctgcccgaccggccgcaggtgctgctgcccgtcctcgcgtacggcctgttgcagaaggtggcggcgggccgtgtcgtacggggcggtcaccactccggaagaggtgcgtgacagcggtggcgttccccgggcgcggattccgttggtggccgggggaaccggcgccggttccaccgtgcacggctgcgccgttgagcgcctgtgccacggcacccaggtcccatccggtggctccgggacgggctgcccgtggccgctcgcgcccgccgtggccgccggggcggcgggagcggtgtgccggccgcggagctggggaccggcgccgcggcacctcttcgaacatcggtcatgcgggcggttccacgagcggctggtggccgccaggacccggccgtcggccggcgccgtccttgtgcgatgccggccagtaccgtatccgcggccttaccaggccacgggcagctcgatcgggaagcgtcggatcgtctccgtgtcccagcgcacttcctccggcggtacggccagccgcaactccgggaaccgctccagcaaccgcccgatggccacttccagctccgccatggccagcggcacggcgatgcaccggtgtccgccccagccgaaggtcatgtgcggcagggacggccggtccgggtcgatggcgtccgggtccgggtagcgctccgggtcacggttcgccgtcaggtacgacacatggacgaagtcacccgcccggatcttcaccccgtccacctccgcgtcctccaccgccacccggggaatgccgacccccttgcggaagggaatgaagcggagcatctcgttcaggacggcggtcagcgtgtccggccggctcctgaggtgcttcatcagctcgggacgggtgaggaggagatagcagatgttgctgatctggcaggtggccgtgtcgtgcccgctgagcatcagcgtcagcgccatgaccgccagttcctggtcgtcgagtacgtcctcgccgtccttggcggcggccaacgcgctgatcaggtcgttcccgggggagctccgccgcttttcgaccagtccgccgaagtactcccgcagctcggatttggccgtcgcggcgctctggcggctgtccgggccggtggagagcagttggtgcacgtactgctccatccggggccagtcgtcctgttcgatcccgagaacgtcgcagatggtgtgctgcgggagccggttcgacaagtggtgcgccagatccgccggcggcccctgcgcggccatctcgtcgagcagcgtgtccgcgagccggacgattctccgtctcatccgctccacatgccccttggtgaaggcctgcgataccaggcggcgcagacggctgctgtgcggcgggtccaccacattgatcgactccggggagacgatgggctccggtgtcagccggggatagtcggagcccatgatccccgcccggctgaaccgctgatcggtggtcacctgccgcaccgcgtcgaacccggtgaccagccaggcgtcggcatcgccgtacggcagccggatgcgggtgatggaatcgcgggccatgagctccgcgagcgagggatcgaactccaggcccttgctgaagtcgaacgggcacatgattgcttcgtcgcttggggtcatcgcgctgttctccagttccagccgccttcattgatccatgcatatgccaattccgcgttgcttagacgcctggatacctccacatgcgctatttggcccccgctgtacccgatgccggaggacaacgggcggggcacggggtcttccggcgatcccggtatcggcgccacaaggtgaggccgaagggaccgcgcggctcggagacaccgcggatcccgccgcgccatgaccgtgtgtcctcgccggaccgcacccaggaggaagccgcgtaccgcccgcgcacccgacggccggcagctgtcacccggcagccgcaccgtgtacgacgtcgtgacgcaccagcaggccgcgatgcccgagcagccgctcacggtgcaccgggaagtcgaggccgcgcagggcgtcccggaacggaagcctcacccgggagccgcccggcgagcgctcaggacgcacgtgggggctctgaaccgagcggctgtcagctcagctcgccctggaacaccgtggaacggcacgcccgcgctcacccgggggcacgttcggagcggccgccgagccgggcaccggcggcttccgccggcggcccggcggccgccgcctcatcccccgtgccggtacgcggcgtcaaggcgcgccagctcgtcggccgtgagcctgatggcgcccgcggccacgttcgccgcaaggtggtccgggttgccggtgccggggatggccagcacgtgcggaccctgctggagggtccacgccagccgcacctgcgcgggcgtggcctcgtgcgcccgcgcgacggcgcggatctcgtcgtcctcgctgccgctggagccctgcgcaccgccctccccggcgatcgcgaagaacggcacgaacgcgatgccctgttcgccgcacatccgcagcatcgtgtcggccccggcatccggcgagtggagcccgtactggttctgcacgcacaccaccggcgcgatcgcctgcgcctcggcgaggtgccggggttccacgcaggagatgccgaggtgccggatcagacctgcttcgcgcagttcggcgagcgccccgaagtgctcggcgatcgagtcctgccgcatacgccggaggttcaccacgtcgaggtggtcgcggccgagctggcgcaggttctcctcgacatggccgcgcagttggtcggggcgggccgcggtgccccactcccccgtgtagtcccggtacgggccgaccttcgtgacgatcaccaggtcgtccgggtacggcgccagcgcactgttgatcaactcgttcgcggagcgcagcgaggagaagtagaaggcggccgtgtcgatgtggttgacgccgagttcgagcgcccgccgcagcaccgtgaccgaccgttcgcggtcacttggtgtgccgaggtggaaggcggcactgcccgtcagccgcatcgcgccgaagccgacgcggttgacggacaggtcgccgagtttccaggtgcccgcggcctccgcggtgatcgtttccgaggtcatccggggagtgtggcacacgggcccgcagcccgacgggcgtgctttacggatacgtgtatgtgttcagggtgtccacggccgacgtcgggttgcccaggtcatagcggtccacggcgaggaagttgggcttcttccgggccgccggccggcagaaccgctgggcgcggtcggcgagtttggtgttgtccgtcgtggccgtggaggcgatcgccgcgtcgcggaagtggttcatgacgaagagcgggcggaaggcggattcggtgtacgtcagcgggatgttggtgtcggcgccgtaccagcggctgtagcaggaccagtcggaggagccgaggcccgaccccatggaccagtagttctcgaccgtccactcccgctggtacatcaccccgaagctgtcccgggtgagcccggcggactcgtcggaggagcggctgtggtccgtgaagatcagcagccggtggttggcggcgatcaggtccgccatcctgggccagccgctttgccgcacacccgtccggtcgggccggtacagcacgtcggacagtccgctgacgcgggcgagttcactgcgcaggacgcccgggtcgacgtagtcctcgagaaacacggtgacgacctggtcggggtgctgcttgaggaagtccaccatgcgctggatgtcgacccagagggcgaccggtttgctgaccagggtgcagctgttgtggcagaggatcgcgccgtccgaggtctgatggatgtccatcatgaatccgcgtacgccgtcggtcagttgctggttgatgccgcgcgtctggttgggcaccaggttgacgaagggcggtgcgaaaccgccgtccacgccgttggcgtacgcgttgtgggcggtgaggaacgtgacctggtccagggtgcgttggtcaggggacggcatggggttgaccgagggggtgaccggggtcaggtaccaggaggccagactccccgccgaaccgatggccaactgggcggggtagttcgacccggagggtttcgcgccgacggtcagatgacggtcggttcccggcgccttgagcgtgtactggtcggtaccggccggggtgatctcccaggccgcgtcggcgctggtgcacacgaccgttctggcctggtcgccggaacggccgaggcagctgccggctgtgtcggtactctccagcaggtacgcggatccgctcgtccgcagattccactgctggtggtcctcgttgcccttcgggttgtgctgttcgactgctcccgcgttgtcggcggcgttgagaccggtgacggcactctgaacgaagtaggcaccgccggtggggacttgggcggacacggcgggggtggggacggcgacgacgacggccagcgcggcggtcgtggcggtcgcggcgagcaaggcgcggggggttcgcatcactgtcacgatgcccttcatcgggatcgacggtcaggtgcatgacatcatggccgttgcggccgccgggcgggagacctggtagtggctgatgtatcggccgaccatccgccggccggattcccggccccccggggccgccaccccgctgctccatcacggccaccgcggcgactgcggccaccaccaggcaccgggtccccgcacccccggccggcgtgggacgcaccgtccccggaccgcaggccgcaccggcggacaccccgcccgcacgcccaccgcccgccgctgacgcagccgggctagagtcggtcacgtacgagaagcaccttttttcccggacatcgcgccggtctcccgccggtcccaaggcccgcccccacaagcggccgcgcgccccggccaggccggctactcagtgaggtgtcgccaccgacgcctctgacgtggagcccttcatgactacaccgcgggatttgttgatcgtcgccatggacgtggggtccagccgttatgtggagccgggcgatctgtcgctcgccctcgcgggagccgaggtgatcgatctcctcggcgccggggccctcaccctggagggcgatcgcatcgtgtcgaacaaccagtggacactgggtgatcgcctgctggacgaggccgcgtcgtcactcgttcggcagccgccccacgagccggtcgaggactggctgtggcgccggggccgcggcctgtcccaggcatatctggccgccctggagacggaaggacaagtcgcccggcaacccggccgctggctccccgtccggaccggccgcacggcactggtcgactcacccgcccggcgccacgccgccgaccgctgggcatcgggcgagcccgtcctggccgtcctcgcggccgccgccggaatccacgacctgccgaccgaggactccccgagcatcgccgacgaggcggtcgtgacggtgctcgccgccgtcaacgacgcggtgatggagctggaagccgtacgccagcggcgatccatcgaagaagcggccttcgacaacatctggcgaggcccctgacacgaggcacggacgcacggtgagccgtgcccctcaccgagctcctcccgtcaccgagctcctcccgtcatgcggggcaggtatttactggaggccgaacaatcacgctcggaataatcgctccataccccgcgtgcccctcaagaaagcaaccccccgatgcgccggctgcgctttctgcctcgacatgcacgcgaaggacgcccgctcccggcttcaccgaacgcgagcgtgccgcactggcgtcgaccgaggctgtgaccctggtgcacgacggacacgtaccggacgacgtgtacgcggaggccgcccgggtttcttcgacgaggcacagctcgcggtgccgagcaaacagctgagtgtgaatatcgaattcccgccgggtcgaattcaccagtgccgacccggcgcgctcctccgtatatcccgtggactcggtcgggatatctcacggaatcagtcaggcagcggctccaggatgccgtccagccattcccgccattccggggcacgcacagcgaacccggcgttcatcggccggcccgtccattccaccacgggccgaattccgtgcagagcgttcaccagccacacctcacggccggccagctccgccggcgtccgctcgcggtgcgcgagccggatccccgtcctcagggcccgctcctggacaaggccgacggtgaccccggccaggaccggcagctgcggcggtggcatgcagagggtgtcgtcctcccaccacaggatgctggagttcgccgcttccagcaccaccccggagggcgtgatcagcacggcctcctccgccccctgcccgccggcccgcagccgcacccggcccagggcgtccagatccgggcccttgcgccggggcacggtccgcggatcgggctgcccggccgcccacacccgcacctcggtggcgagaggcggcgcgtgcctgagcagtagcctcagctggagggatcctctgaccagctcgacccgcgggaaccacgtccccgcccgtggcaggaccgccgtcatctcccgccagaatgcggtgagttgatcgagcggcggcgcaccgcactcggcgcaggcgcgccgaaaacgctcacggtggcggtcgaagccgcgcaccagtccgtcgcgcagcagccacgagtccgcggccagcagccgggtgtcggccgccagaccacgggtcagtccgctgtccgggttccaggccaacaggccctccgcgattgccggttgtgtcaccgtggctcctctcagttctttcggccggcgctcgccggcgagccgttccttggtccgcgaactccccgacccgccgtcgccgtcccgttcgcgacggtcttcgccgcggccgcggcgtcggcggtgccgctgttcatgccgcgcgcgccgaacggcgggaagaggtgggccgcctcacccggccggcacggtgtggccgaggtcggtcccgaggccggggtggatgcccagcggccggtccagggtgccgaagacggctccgtgacggtctgcggcctgccggaacaccggtcccggacaagaaccggggccggcgaagaggggctgtgacatgggcccgttccttatccgcggtgggcgcggacgccggtgcgtccacggtcaccacgcgccctggcggacgaggtggcggcggagcttcccggtggcggtacgcggcagcgtgggtacgaagctgacgctgcgggggacctggaccgcggccaggttgtcgcgggccaggcagaccaggtcggcctcaagacctacgggtatcggagtgacgggcacgacgaaggcccggagcctgcccgcgccgcgcgcgtcggtgacggccgcgaccgcgatctccctgaccgccggatgagtccccagcagggcctccacctccagcggggagacggtgctgccgccgaccgtctccatgtcgtcggtccggccgaggtgccggtaggtgccgtccggttcccgacgggcccggtcccgggtggcgagccagccgccgacgagggtgcggtccgtctcctcgggcaggttcagatagccgggcgtcaacgaaggtccgcgtacccacagttcaccctcctcgcccgcccccacggggcgccccgagcggtcccgcagctccacctcgaagccgggcaccgggcggccgacggtccccgggtgatggtggtcgaagctgttggcgcagaacgcgtgcccggcctcggtggagccgagctgctccagaacgggcgcgccgagcagctcggcgacctgctccgccaacccggcgggcatgccctcgccggccgacaccgcggcccgtacggacgcgaaacacgccatgtgcccgaccgcccggtccgccacgagggcggcgtacgccgacgggacggagtagagcagggtcacccggtgccgggcgacgagtccgtcgacggccgcgggggtcgggcgcccgtcgaccagtacggcggaggagccggagaacagcgggaagacgaaggcgttgccgaacccgtaggcgaagaacagcttggacaccgagagggtgacgtcgtccgcggtgatccgcagcagccgtcggccgatgagttcgtggtaagtccccgggtcgccgtgacagtggacgacgcccttgggtctgcccgtagtaccggaggtgtactggatgtacagcggggtgcgcggcccgaccgggtgggcgtcggcggcgggcgaggcggtgccggcgagcgcgaccagctgatcggcgcccagccgccgccggtgcgcgaagcgtctctccagccccggtccggtcacgcacagcgcggcctcggcgtcgtcggccatgaactcgtgctcggccggggtgagttcggggttgacggggaccgcgacggcgccgagacgggcggtggcgaggaaagccgtcacccaggcgagggagtcgggcagcgcgagcagtacccggtcgcccgggcggactccgtgctcggcgagcacggtggccgtgcgggccgcgaggtcgtgcacctcgccgtgggtccagacctggtggccctggcggaacgcggggcgcccggtccagccacggcgctcggcccggccggcgagtacggccgcgaggttgtcggacgtgcccgcttcggccggactcagggtgggcagcggcgccctcatcggaccgcctccttcagcgggagcgtgcgggcggcgggccgcaggccggcgatccggtcgcggtgggcgcgcatcggtgcggccgtcttcagcagcatctcgtcgtactcgccgaccggatcggagccgaggacgatcgcaccgcccgcgccgaggtgcatctccccgtcggtgaacacggccgtgcggctggcgatggcgaggtccgcgcccccactgcacccgaagtagccgatggctccggagtacaccccgcgggcctcggtctccagcgagtcgatgatctccatcgtgcgcagtttcggcgccccggtcaccgaacctccggggaagcagacacgtacgcagtccaccgctccgatgccctcgcgcagccgcccctcgacggtggagaccaactggtgcacggtggcgcacgtctcggtcgccatcaggcgggtgaccttcaccgtcccggtccggcagacccggcccaggtcgttgcggagcaggtcgacgatcaccaggttctccgcgcgggtcttgtcgtccgtggtgagcgcgtcccgtagccgggcgtcctcctccggccgctcgccgcggggcgcggtgcccttgacgggtctggcctcggcgacgccgtcgcgggtgatccgcagaaaacgctcgggggacgagccggccacatcgaggtcaccgaaccgcagataggccgcgtacggcgccgggtcgagacgacgcagtacccggtagaagtcgtaggggtcgtacggggcgggcagcctggccgcgttggtcagacagatctcgtaactggtgccgtccttgagttcccgcttgcaggtcccgatgtccgcgaggtaggtcgtacggtcgcggaccagccacggctccacggcatcgaggcggggtgccgtcggccgcggcggggcggtcggcttggccgaggacacgaaactgagctgggccatcgccgcgtcgagccagtcggccgcttgctgtgcgccctgccgggtgttctcggcgagacagacggcgtaggtggctccgtcctgatggtccactgcgatcagccggtcggcgaacagccagcaggcgtcgggagttcgggcccgatgacggttgacggaaccgcagtcggccttcacctcgtagccgaagtagcccacatacccgccggtgaagtcgaacggcagtcccgtggcatccacctgacgggtcaccaactgccgtttcaggtagtcgaagacgctggccctgaccttgcgcacgggccgcccgggccgctcgatctcacagaggccgctctcgacgtcgtaccgtacgaactcggccagcggtccggtgccgtcaccgaagaacgagaaacgggactgtccctcctcgacccgggagctgtcgagccagaacgcgcggggcgcgtcggtgtacatccgggtgaaggccgcctcggcgtccacggccacgtcgatccgccgggtgtgaaggcggtgggacggggccacgcgacggggccgggggaccagcacggcgggtgctgccccggccccctcggcgcttggggacgggggccgcacggggggctcggtcgtgcgcgttccggacgtacgggccttggccgtgcgagtctcgcgggcgcgggaggccgtcagctcgcggaagttcacgaacatccggtggccgaactcggtgaggacggactccgggtggaactgcaccccccacagcggccgggagcggtgccgcagtcccatcagcacgccgtcctccgcccaggcggtgggctccaggctcagtggcagcggttcccgtaccgacagggagtggtagcggaccgcggtgaactgctggggcaggccctcgaacaggtcctggccgttgtgccggacggtggacagatggccgtggcggggctccggtgccggggtcacccaggcccgctcccccgccgcgatgccctggtggccgaggcagacgcccagcacgggcacgggggccgcggcgagcagctcgccgacgatgccgaagtcacgtctcttcgcggggtgtccgggccccggcgacaccaccacgttggcgaaatcccggagatccggaatgtcgtccggcggggcgtcattgaggacgaccaccggctcctcgccgttcacctcggcgatcagctggaacaggttgtacgtgtacgagtcgtaattgtcgatgagcagggtcttcacccgcccacctccctttgttcgttctcagccttgcgcagtccaccgttcgggccggccaggaatgcctgaagcgacggagtgcggatgagagaattgaggctgccaagacaggggagcacggccaggttgaagagaagtaccggcgggaaaaccgtgctcacatcgacgaaccgcagtttccatttcggtggcggacgcggtgcggccggggtgacggtccccgagtcgaaccaggccgtcgagccgtgcacaatccggtccccggcctcccgggcgagctcgtccgcgcgggccgaccactggattccggtgaccgaggcgtcccagtcccgggcggaaccaccgcagccgaagcggtagaccacatgccactccgcccctcccccgaccagcacgccaccaccgagaaaccctgactgtcccgcgctcgcccacagaagggcccacccccaggagtggaagcctgactcacggcccggcaccacgtgatacgccccggcgacggtaacggaattcctggtcaccccttcggatacgagacaagggcgccgcctgttcaactctcaatagaatcctttcacaacagcccggaacgcacgatttgccggattttcacgcatcttcatatcttttgtcacacgctacttcgggtaacttgagaaaacttccgaaaccgcttactgagaggaatcgagcggacccgcatcgcactcgaaccggaccgcgaaaacgtaactgttcatccggtttcaacggcacataaaaagccctgacgcacggcgacactcatttcggccggagcgagttcggcgtcccgggtatgccgtacttccggttgcgagcgggcaccccgcgtgagtgacttggcgtgcttttctcatcacgcaaagacaaggaagtgccatgtcccccgactcagcggacagggctacggctcgcgccgtctggtccgacttctgtgcggtctcacccagcccggaactgcgggaccggctgcggagcgatctccaacgcatacgtgagaccaacaccggactcgccgcccacatagcgccggcccgtacccctcgccggcccggcttcgacgacggcacgatcattccccccgaggagttccccgccggaactcccgcggccagaatccgcgccgccgccgccgagcgcgccccactgcgggggaccgtccgggtgatcgtggtcctggtggacttccccgacaaggagctgacggccaccgcccagcacttcagggacctcttcttctcggagaacacgctggaacacggcagcgtgcgggactacttcaaagaggtcacccacggcctggtcagcatctcgggcgaggtcgtcggcccggtcacgctgccgcacacactcgcctggtacgccaacaacaacttcgggatcggccgtccctccggtgaggcccgggccaacatcatggccagggacgccgccatccaggccgacccgtcgatcaactacgccccgtacgacaacgacggcaacggtttcgtcgacgccttcgtcctcgtgcacgcgggcgaaggcggcgaggtcaccggtgagcccggcgatctgtggtcccacaagtggaccctgcccaagccctacccctcggacggcgccaagatctacggctacctcaccatcccggaggacgccaagatcggcgtctgcgcgcacgagctcggccaccttctcttcggcttccccgacctctacgacatcgacggcacctccgaaggagtcggcgactggtgcctcatgagcgggggttcatggggtggaggcggcgacatccccgtccatccctccgcctggtgcaaggcccaacagcagtgggtctccacccagcgcgtcacaaccgacggaacgctggcgctgcctgatgtgaagaacggcttcgaggtgcaccagctgtggaagcgcggcgccccgggccgcgagtacttcctgctggagaaccggcagcagaccggctacgacaggtccctgcccgccccggggctgctcatctggcacgtggacgagaaccagcccgacaacagcgacgagaaccactacaaggtggggctcgtacaggccgacggctgtcgcgccctggaacagggaggcaaccgcggcgacgagggcgacccctacccgggaagcacgggcaacaccgccttcaccaatggcagcgatccgtcctcccactcctacgccggagccgagaccggggtgtccatcaccggcgtctcggcacccggtgaggtgatgacggcccacgtgtcactggcccccagcccgaccgagcgcatgaccaccgagcgcatgacggccgagcgcatgacagcggcagcaggcaccggcgcccgggccgagaccacccccgaactcgccggcgagatcctggagatacaggcccggctggcggcgatggagcaagacctcgcgagcatcgcctccaaggtcctcactcccctcgtccacacggggatgcagtccgacgcggcccagatgacggcggcacacggcaacggccgaccgataccgcagtaatccatggtgcaggcgatcgagaacctgaccaccttgcgaatccgcctgatcagcagggccccgcacccccggctcgccgaatgggaccaggtggcggccgacatcctcgatgccgacccggtgcggggctacgccgacctgctgtcgcaccgtgtgggcgggcgcgtggagctggcgatacgccgcgacctcctcgacggcgcggctcccggtgcggtcatccggctgcgggccaagctcgccgccggcgagatcgtggccgaaccgcacccgccacctggggagttcaccatcacgcccgcgacgccgtgacggacctgacgagggtggcactcgcccaacgcccactggcgatactcggcatcgcgcgtacatgaccacgaaccggacgatgacgccgctcggggttgtgccgatcccggcgcgcatcgtgacccgccgacattcgacgcgcatggctggccgaatgtccgcgatcgaaaacctggcgaggtcgcggaaggctcaaggatgtgcccggaattctggtcccctatcggccgaccggcgcgatacacccggatgggtcaagaactggttttcgagtttcgcgtaaattttcgacgggaacctatttgtcgcagttcatgacgatagaccggaggagcccatgtcccagaaggattccgtcgaggtggaaccgacgaccgacgcggacgaggaaacgctggaccgtgcgctggcttccggcgcggtcgccgacacgtccgggtccgaggtgagtacgagcaattcgcgccccggcggcgggccagggatcgccggacggcccgatggccgcccggtcgcccgcaagcacccggcttcaggataaaggaggcgccatgtccctgaatctcaagaacaactaccaccaaccggtctgggcgatggtcgaatggcaccacccgaactgctccgacggcggagactggatgaagaagggctggtggaaaatcggccccgggcagacctcgaccgttttcggcgatgacgtccacgcggtgaacccgatctggtactgctacgcgcactcgagcgacggtctcgaatggcgggaccgctttcaggaactcgttccgacccatgccttcgagtggtgttcgaacaccgccgacacgagttcgcggacgatcctcatgaacgagttcgtcgtgagccgcccgaaccacgtgcacacgtttttggcgccgtagcggtcaggccgccgcgcgcgtgaggcggagggtcgccgtgaccgtggtcaggccgcgcatcatgctcagctggttccagcccatgccgaactggtcgcggtccgcggtgaactcggccgccagcgtgatcgcgtcggagtccgcccgcgtgacgcgcgccgtgaacgactggggccggctgatgccgcgcacggtcagctggccggccacctgaacagtgtcgcccgggccggcttcggcggtgcgtacggcgaacgtgatctcggggtggttctcgacatcgaagaagtcggcggagcgcagatgcgtgtcgcgcttggcgttcttcgtgtcgagggaagcggcctccagggtgatcgtgccgtgggcggtgccgtcgggctcgacctcaccctgaccgctgatcgaggtgaaggcgcccttgacggtgaccagaccccacatcgtcttgtgccggacggcgacggtggaggcggtccggtcgagctgccacaggccggtttcgacggcgagggtcatgagcgttctcctgacaggaaagtggagggacccgggcagggggtgcctcgggcggacgaccaccatgtcgtccaattttgaatgacttcacgctagcccatcatccaaaattgaacaaccaactcttccaaaattggacgaccggtagaatcagggccatggccgaaccctctgctcccgcggacctgcccgagcacgtccagacgccccaggacgggctgctgccggccgaacttcgggcgtggatgctgctgctcgccgcgaccggcgcgatcgagcagcagctgcgcgccgtcgtcaaagacgccctcgggatctcccacgacgagttcctggtgctgtgcctgctcgcggaccagcccggcagcggcctgcgcatgacgcggatcgcggaacttctgggccgccccaagacccggctgacctaccaggtcgcctgcctccagcacgcgggcctggtcactcggcagtcggtgtgcggcgacaagcgcggggtccaggtcaccctcaccgacaaggcgcgtcgcgcgctcagcgaggcctccgtaccgatggccgacgccgtcagcgaggccctcgcccgtaccatcggccccgcccagcgcgaagcgatgtacggcctgctgcccaccgattcctgcccgcccgacgacgcgtgagccgcacgcccgaagcgtgaccggcgcacagcccgcacagtcctgcggcgccgctgggcggctcggaatcagaagccggggagcacccggcgcgggtcgtccggggccggaccgtcacccgtgaaggacacggtgcgccgaggacggcgtcgggccgggccggatcgccgttggtgagcgcgaccgggtcgcccgcttcacggcggtcacgtgtcacacggcggcctggaacgaccgctcggcaaagcccgtcgacgcggcgcgttcggccacgtcaccccaggccggcgcgtgggcggcccggccgtcgaagcagggcgaccagggcgaagccgggcgaccaggacgacgggatggagcgggctaggaccgacggcgcggcttgcctcgcttgcccggcttggcgccgccccctccgctgcgcgtgctcttgccggtcgtcttcccggccgcgggcttccgccgcgccccgctcgcgtcggagcgcttggccttcgaagccttcggctccggcggggtctgggaacgcccgcgtgagctgttggcggtgcgcccgcggacgatgccgatgaagtcctccaccaggtcggtggtctcgtcctcccgccacgagagggcgacgcgcgactcgggggcgtccgtgaccgtccggtaggtgaggtccctgcggtggtgcaggcgggcgagcgactgcgggacgaggagcagtccgactcccgccgccaccagctcgacggcgtccgccgtcgtggcggggcgctcgatcgcgggccgaccgggcaggtgctcccagtccagggtgtcgtccagggggtgcagcacgatgtcatcggccagatcctccgcggacacctcgtcgaccgccgccacgaggtggtccttcgggaccacgaccaccgtcgtctcggcgtagagggggatcgcgctgaggtcggtgcggtcggtcggcagccgtacgaacccggcgtcggcgccaccgtcacggagcaggtcggacgcctcggcagcgggtaccgggatgagggtcagggggatgtcgggcagccgctcgttccagatccgcacccacttggccggtgtcacgccggggacgtatgcgagccggaatgaaggggttacctcggagcctgtcactccgccaggttaccggtgctggtcagaggcgtcgcacacgctcgttacccttgacaccatgacgtcgcaccagaccacccagaccatgaagcccgccaccgcggcgaagaagctgggtgtgtacctcgaggccacccccgccgagttccaggagggtgtcgtctcgcgcagcgagttgaacgcgctgcaggccgatccgcccgagtggctccaggagctgcggcgcaacggcccgcacccccggccggtggtcgcggcgaagctgggcgtctccatcgccggtctcgcgcgcggcggagtcacggacgcgctcaccacggagcagatcgacgccctgaagcaggaccagcccgagtggcttcggaaggagcgcgccacccaggccgaggtccggaaggagtcggcgcgcatcaaggagcagcaggagcagaaggcgaaggacgcggcgcggggcgatcgccgctgaccgcttcgttccctctcggcgacgcggttccctgaggccggcttcaggcggaggccggccggcccgaccgtgcggcccatcagtagtgctcaaggtcgccatgccggtgccgctgcggcaccggcatggcgaccccgcccgcgaaggaccggccgtccctcggcgcgtcagacgctcagcggcttctccagcaccgccttgcggtgactgaacgtctcgatcgagtagcggccgtggtagttgcccataccgctctcccccacgccgccgaacggcaggtcggagacggtgagatgggcgagcggcaggccgtagccgagccctccggaggacgtctcggcggcgatgcgctgccgggtcgtgccggacgcggtgaagacgtacagggcgaggggcttgtcgcggtcgttgatgaagtcgatcgcctcgtccaggcccggcaccgtgacgatcggcaggatcgggccgaagatctcctcccgcatcacgggcgactcggggtcgacgtcggcgaggacggtcggcgcgatgtacttggccgtacggtcgctgccgccgccggtgacgacccggccggagtcgagcaggccactgagccggtcgaagtgacgttcgttgacgatgcgcccgtactcgccggaggtctccggttcggggccgtagagcgacgagacggcgcgggcgagctccgtctccagggcgcggccggtctccgggtcggtcaggacgtagtcgggggcgacgcaggtctggcccgcgttgaggaacttgccgcgcgcgagacggtcggcgacgacggcgaggtccgcgtcgcggtcgacgaacaccggggacttgccgcccagttcgagtgtgaccggggtcaggtgctcggcggcggcgcgcatcacgatgcggccgaccacgccgttgccggtgtagaagatgtggtcgaagcgctcggcgagcagggcggtggtctccgggatgccgccctcgacgacggcgaccgcatcggtgtcgaggtactgcggcagcagacgcgcgaggacggccgaggtggcgggggccagctcgctgggcttgacgacgaccgcgttgcccgcggccagcgcgccgatcatcggcgtgagcagaagctgcgccggatagttccagggagcgatgaccagcacgacgccgagggggtcgtactgcgtccaggccgtcgcgtcgtcaccgaggtgcggcgggaccggggcggactcggggcgcagccaggtgccgaggtgggaaagcgtgtggtcgatctcgcggacggtgaagtcgatctccgtgcggtaggcctcggtgctgctcttgcccaggtccgcgtggagggcggcggcgaggtccgcgccatgtgtcgtgagcatctcgcgcagtcggtccagctggtccgtgcgccactcgacgggcttggtacggccggtgcggaaagtggcgcgcagccgggccacggtgtcggcgggctgctcgggggtgcggtcgttcacgatgcctcgctggtcggagcacgggcccgatggcccgtggagatggtcgcgggcgagcggacggcacctcgcaccgtcgctcgatgtaaatgccaacctttcaggtgcccaaataaattccaggcacacgtacatcacttacggcaatgcggcgatcactcagaggcccgattccacggccgccccgtcgagcgtgcccgccagccggtccagcagggcccgcagcagttcgtcgtcgccgtcgctgagcacaggccaccgcgcgcggatctcgcggtcgagccggcgccagtacgtccggccgcgcggggtgaggtaggcgaggatgcggcgtcggtcgagggggtcgacccggcggtggacgaggttctggtcgacgaggtggtcggtcagcttggtcaaggtcgcgggcggcaggaaggccgcttcggcgaccgccgtcatgtggtgcccctcgccgtcggagagcagggcgagcacccgccaggcgtccagcgagcagccgtcctcgtccagcaccgcctggaggtggcgcgcggccagtcgctcggcccgcgtgagcagctgcatcaggtcatggggccgacgcggaggtggggtgggcatcctgctcctcatcctcatgacagggtgcgtacatcgtatgagacggactggagttcaccggggggacccgaaatcatgacgccatgttccggcacgatccccctgcgcccgactggttcacggtcgacgactccgtgctccgcgtggcgctcgtatttcccctccaggggtcggcggggatcttcggaccgacctgcgaactctgtgcgcggctggccgcggaggaggtcaaccgggcgggcggggtgctcggcaaggagctgcggctgctgcccgtcgacggcggcgcgccgccgcgcgagatcgccgaccgggtcgcggcgttggtcgacctgggcgtcgtgcagggcgtcacgggctggcacatctcctcggtgcgacaggcgctggcgccgaggatcgctcatcgtgtgccgtacgtctacaccgccctgtacgagggcggtgagcacaccgccggtgtgtttctgacgagcgagaccccgcgcgatcaactgcgacccgccatgcggctgttggcgcgtgagcgcggggtacgtcgctggttcgtcatcggcaacgactatgtgtggccccgccgtaccgcgcgggcggcgcactcgtacgcacgcgagtgcggcgggagcatcggcggggaggtctatctgccgctggggacccacgacttcgagcccgtgctgcggcgcatcgaacggtcggacgcggacgcggtgctcatgctgctggtcggcagtgacgcggtgcgcttcaaccgggcgttcgccgcggccgggctcgacgggcggtgtctcaggctgagcacgctgatggacgagaacatgctgctggcgagcggtccggcggcgaccgcggacctctacagcaccgccgggttcttcgcctcgctggcgaaccaggacacgctcgacttccacggccggtacgcggcgcggtacggcgtcgaggcgccggccctcggcagtctcggcgaatcctgttacgagggagtgctgttgctggccgcgctcatcgggcgggccgggacgctggaggtgtcggccatcggagcggcggcggacaccgtgtcgtacgagggtccgcgcgggctgctgcggctgcggggcgggcatgtccggcagcgcatctatctggcgcgggcggacggcctcgacttcgacgtggtcgccgaactcgatctccacagttcccgcccttgacatgcccgcgccgctgccaagatacttcccacagaaagtaactagaatgcctcgggcgaattgtggattccggtgtcgaattccgccccaggcattttttgttgcccggtgagagcgggaagataccgccgggaaagtaccgcgaaacacctcggaaacagcgcgacttgaggctgtggaccgcgcttcaggagggcgccgtcctccactgcccgagggggttcttttgtccagcggtcccagcggttccagccgttccagcggttccagcggttccagcggttcccgtattctccgacgccggttcatggccggtacggccgcgctcgcggccgtcgtcgcactctccgcgtgcggcgccaagaccgacgcgggcggctcgtccgacaaggccgcccaggcggacgtgagcggcgacacggtcaaggtcggtctgctcaactcgctgtccggcaccatggcgatcagcgaggtgaccgtacgcgactcgctgaagctggcgatcgacgagatcaacgcctcgggcggagtgctcggcaagaagatcaagccgatcagcgaggacggcgcctccgactggccgacgttcgccgagaaggcgagcaagctcatcaaggaggaccgggtcgcggccaccttcggctgctggacctccgcgagccgcaaggccgtcaagccggtcttcgagaagaacaagtcgctgctgttctaccccgtgcagtacgagggactggaggagtccccgtacatcttctacacgggcgcgaccaccaaccaacagatcgtcccggcgctcgactacctcaagagccagggcaagaagaagatctacctggtcggcagcgactacgtcttcccgcgcaccgccaacaagatcatcaaggcgtacgcgaaggccaacggcatgacggtgctgggcgaggactacgcgccgctgggctccaccgagttcagcacgatcgccaacaaggtgaaggcggccaaggcggacgcggtcttcaacacgctcaacggcgactcgaacgtggccttcttcaaggagtacaagtcggccggcctgaccgccaagagcatgccggtcgtctcggtgtcgatcgccgaggaagaggtcaagtcgatcggatcgcagtacctggcgggccagttgacggcctggaactactaccagaccaccccgggcgcggcgaacaccaagttcgtgaaggcgtacaaggccaagtacggccagggcaagccgaccagcgacccgatggaggccgcgtacacctcggtctacctgtggaaggcgatggtcgagaaggcgaagtccttcgacccggagaaggtgaaggcggcctccgacggcatcaccttcgacgcgccggagggcaaggtcaccgtcgacggggcctcgcagcacatccgcaagacggcccgcatcggcaggatcggcaccgacggcctgatcgagcaggtgtgggactccgggaagccgatcaagccggacccgttcctcaagggctactcctgggcctccggcctctcctgaccgcccgtcccgcggggacctcgccccgaacgggggtccccgcgtcccgcctccccggagccgccgtatgaccgtcatcttcggtcagaccttcaccggcatcagcatcggtgccgttctgctgctcatcgcgctcggcctctcgctcaccttcggtcagatgaacgtcatcaacatggcccacggcgagttcatcatggccggcgcctacaccacatacgtcctgcagaagtccatttccagcgccggattgtcgcttctggtcgcgctgcccgtcgcatttctcgtctcgggcgcactcggggcgttgctggaatggctgctgatccgccggctgtatctgcggccgctcgacacacttctcgtcacctggggcgtctccctgatgctccagcaactcgcccgggacatcttcggcgcaccgaatgtgcagacacgggcgcccgagctcctcaccgggaacatcacggtcatcggcggtgacgacccgctcaccttcgccaacagccggctgttcatcctcgggctggccatcgccgcggtggtcgcgctgtcgctgacgctgcggctgaccccgctcggccggcgcatccgggccgtggtgcagaaccgggatctggccgaggtgtccggcatctccaccggccgggtcgatcgcacggccttcttcatcggctccgggctcgccggggtcgccggggtcgcgctgacgctggtcggtccgatcgggcccaccatgggcaccaacgtgatcatcgacgccttcctggtgatcgtggtcggcggcatcgggcagctcaagggcagtgtgatcgtcgccttcgtgctcggcgtgctccagtcggtcctcgagtactcgaccacggtcagcgtcgcgaaggtgctggtgctggtcgccatcgtcgctttcctccagtggcggccccaggggctgtacaccctgcgcacgaggagtctcgtatgaccgggtcccgaacgtcgttcctcaaggggcgctccacccgggcggcggccggcttcacgggagccgccgtcgcgctcttcgccgtcgccccgctcgccctctccgacttccggctggggctactcgccaagtacctgtgcaccgcgatggtcgccgtcggcatctgcctggcctggggccgcggcgggctgctgacgctcgggcagggggtgttcttcgggctcggcggctacgcgatggcgatgcatctgaagatcgtggacgccgggcccggcaccattcccgacttcatgcagttgtacggcaccgccaccgaactgccctggtggtggcgaccgttcgccaacccggtgttcgcgctcgcggcgaccgtgctgctgccgatggccgtcgccgccgtcctcggttcgttcatcttccggcgccgggtcaagggcgcgtacttcgcgatcctcagccaggcactggccgccgcgttcgcgatctggctggtgggccagcaggccacgaccggtggcaccaacggactcaccgacatccagggcttcttcggctacgacctcgacgaccccgtcaaccagcggatggtgtacttcgtcatcgccgcggccctgctcctcctgatcgccctggcccgccagctcatccacagccggtacggcgaactcctggtcgccgtacgggactcggaggagcgcgtgcgcttcctcgggtacaacccggcgaacgtgaagctcgtcgcgtatgtggtggccgccggcatggcgggcctcgcgggcgccctcttcgtccccgccgtcggcatcatctcccccgcgctgatcgggatcgtgccgtccatcgagctggtcatcggcgccgcggtcggcggccgggcgagcctggccggcgcggtgctcggggcgatcgcggtcgcctgggccaagacggccctgtcggaggagttcccggcggcctggacgtacttccagggtctgctgttcatcgtggcgctggcgttcctgccgggcggtctcgcctcgctggtggggatcgcacggcggcgcagggcctcacgggtgtccgccgacacggcgcccgtccttcccgtgggagaagcggcatgagtgagctgtcggaccgtgcgggcctcccgggcctcgaaatacggcaactgcgggtgtccttcgacggattcaccgccgtggacggtgtggacctcgacgtcaggccgggtgacctgcgcttcctcatcgggccgaacggtgcgggcaagaccacgctggtggacgcggtcaccggcctggtgaaggcggacggctcggtgcgcttcgggggcgcggaactgctcggacggagcgtgcaccggatcgcccggtccgggatcgggcgtacgttccagacggccaccgtcttcgaggagttgacggtgctccagaacctggacatcgcggcgggcgcgggccggagcgtgctgacgatgctgcggcgccgcacgggtgtaccggagtccgtcgcgcgggccctggagacggtcgggctcacggagctcgccgacagcccggccgggacgctcgcgcacggccagaagcagtggctggagatcggcatgctgctcgtgcaggacgtacggctgctgctgctcgacgagccggtggccgggatgagccacgacgaacgccagtccaccggtgagctgttggagcggatcagcgaggagcggaccgtggtcgtcatcgagcatgacatggacttcatgcggtccttcgcgcgcagcgtgagcgtgctgcacgcgggcagggtgctgagcgaggggacggtggccgacgtgcaggcggaccccaaggtgcaggaggtgtacctcgggcacgcgccccaggagtccaccaccgccgagccggccgcgggcgtggccgtacaggaggcgtgatgctggagatcgacgacgttcacgtcggctaccaccgcagcaccgtcctgcacggcgtctgtgtcgaggtgccgaaggacggcgtcgccgccgtgctcgggcacaacggcgccggcaagagcaccctgctgcgcgccgcggtcgggctgctgacccccgcgcgcggcgccgtacgcctggacggggaggacatcacgcgccgcaagccccatgagcgggtggcgcgcggcatggcgtacgtaccccaggggcagcaggccttccctcacctcaccaccgccgagaacctccagctggtcgcggacggacgcaggcgcggcaaggcggcgatcgccgaggcgctggatctgttcccggcgctgcgggcgctgtcgaaccgccgcgcgggtctgctctcgggcgggcagcggcagcaactcgccatcgcccgcgccctggtgacggagcctcggattctgctcctggacgaaccgaccgagggcatccagccgtcggtcgtggccgagatcgaggagacgattctcgccctcgccgcccgcggtgggctctcggtgctgctggtcgaacagcacgtgggcttcgcgatgcgggcggcgcagcggtactgcgtcctggaggcggggcgggtcacgtcctttggcgcgggcgggcaggaggcggagcggtcggtgcgggaggcgctgagcgtgtagcggttcactccggcgtgagttccgccctgcggcgctccagatacccgcgttcggccgcgttgtccgtgcgggcgatggccgcctcgtaggcccgcacggcttcggtgccgcggcccaggcgcctgagcaggtcggcacggaccgcgtggaaggcgtggtagccgtcgaggtcgagcgcgtcgacgaggtcgagggccggctgcgggcccgcggtctcggcgacggcgacggcgcggttcagggcgaccaccgggctgggggccagggccatcagctggtcgtagagcgcgaggatctggcgccagtcggtggcggcagcggtaggcgcgtcgctgtggacggcgttgatcgcggcctggatctggtacggcccgggctgatcgcgtcgcaggcagcggcgtacgagcgcctggccctcggcgatcaggccgcgctcccaccggccgcgttcctggtcggccagcaggatcagggtgccctcgggcgtctcacgggccgggcggcgcgcctcgatcagcagcatcagcgcgagcaggccgatgacctccggctcgtccggcatcagctcggccaggagacggccgaggcgcagggcctcggcgcacaggtcctcgcggccgccgtagccctcgttgaagatgaggtagacgacggcgagcacgcccctgacgcggtccgggaggtcggcatcgcgcgggatgcggtacgggatgcgggcgtcgcggatcttggccttggcgcggaccagacgctgcgccatggtgggttcgggcacgaggaaggcgcgggcgatctgcgccgtggtgaggccgccgagcagccgcagcgtcagcgcgacctgtgcctgggtggcgagcgcggggtggcagcaggtgaagatgaggcggagccggtcgtcgcgcacggggccctcctcggccggtgtgccgggcgcgtacagctgggccgcttcggcgtggcgggcctcgcgcgtggactcgcggcgcagccggtcgatcgccctgttccgcgcggtggtgatgatccagccggccgggctcggcgggactccgctctccggccacgtccgcagtgcggtggtgaaggcgtcctggaccgcttcctcggcgaggtcgatgtcgccgaggaagcggaccaggacggcgaccgcgcggccgtactccgcgcggaagacctcctcgacaccgacggccatcaggcctcgcccatgaaggggcgtacctcgatcgggagcgtcgtcgccagtgtcgccttgcggccccactcgagggcggcgtcgaggtcgggggccttgatgaggcagatcccgccgaggtactccttgctctcggtgtacgggccgtcggtgatcaggacatcgccgccctcctcggcccgcagcacggtggccgtctccgggccgtgcagtcccccggcgaacacccaggcgcccgcctcgcgcagttccgcgtggaagacgtcgaggttgtgcatgatcccttccaggacctcgggggcgggcggctcgccggccggctgcatgacgctgagcaggtagtgcttcatgatgtgtcctcctcggtgatctcccacggggtggtctttcactgactacacgaacgggagagcgccggatcgacacccgacacgacgacttcgggagaatttcccagatgaccactccaccggatccgcatccgctcgtcgccggggcgcgccggctcgccgccgaggtgctggcgccccgcgcggagcaggtggaccaggagggggtgcccgcgagcagtatcgaggcggtcaagcggtcggggctgctcgggctgagcgcgccggtggagtacggcgggtcggcggcgccggccgccgtggcccgcgagaccgcggagatcctggccggggcctgctgttcgacgtggttcgtgcagacccagcaccacacgccggtgatgaccctggccaagagcgaactgcctgtgcgggagtggttgttggggccgttggcgaggggggagctgctgtccggggtggcgtacgcccagttgcgcgcgtatccccgtgttccggtgcgggtcacccgggagcgcggcggctggcgcttcgacgggacggtgccctggtacacgggctgggggctcaacgacgtgatgctgctggccggggtcacggacacggacgaagcgctcttcgccttcaccgaggcccgtgcgcagccggggttgcgcccgtcgccgccgatgcggctcgcggcgctgaccgccgcgcgcacggtgtcactggaactggacggcctgtggctgcccgaggaggcggtggcgctgcggacgccgtacgagacctgggcggctgccgaccggcccaagaacaccaacgccggacccgccgtcttcgggatcaccgcgtcggcgctcggcctgctggcggacggcgatccggccgcgcaggagtccgcgcgggtcctgcgcggccggctcgacgaggtccggcggcacgcgtacgcgctggccgaccaccccgtgccgtcggagcggatcgaggaacggctggtggtcaagacacgcgcctacgacctgatgcgcgcggccacgaccgcggccgtggtggccgggggcggccgggccatggacctcggcagccccgcgcagcggctggcgcgggaggggatgttcctgctcgtgcagggacagacggccgaggtacgcacggcgcacctcgggtccttggccgcgccgtactagcgcggggtgcgggtgggtcgcggcgcggttccggctcaccggggttccgacccgccgtgcggttgtggcccgccgtgcggttgtggcccgccgcgcggttccgacccgccgtgcggttgtggcccgccgcgcggttgtggccgccacgccgttccgaccccccgcgccgctccgacccgcccacgcggttgtggcccgccacgtggttgtggcccgccgtgcggttgtggcccgccgcgcgattccgaccgccacgcccttttaaccgccgcgcggttgtggccgccgcgcgattccaacccgccgcgccgttccggcccgccatgccgttccgaccccccgcgccgttccgaccccccgcgccgttccggcccgccacgcggttgtggcccgccgcgcggttgtggccggccggctcgcggtggccggccggctccccctgtgccgcgctagtgctgtgaccgcataggttcgccgggtcggcggtcgtggcggttgcatgtgcggtgacatccgatccgaccgctggaggcgcggtggccgagcccgtccgtgtgcgcagactgaccgaccacgaggggcagaagctgcagcagatcgtgcgccggggcagcacgagttcggtgcgctaccggcgggcgatgatgctgctggcctccgctggagggggcaccggcagcggatgatcaggcggatcccggccggcccgcggagcgggtatgtgcggcgctgatgtgtcctcagacgcccgcttccaccaggtcgtcggtatggaaggtgcggcggtaggaggcgggtgagacaccgaaggcggtgcgcatgtgggcgcgcagggagttggcggagccgaagccacagcggtgggcgaccaggtcgatggacaggtcggtggtctccagcaactgcttggccagttccaggcgttgcgcggtgagccactgcacgggggtcatgccgacctcgtcgcggaagcggcgggtgaaggagcgcaggctcatccgggcgtgttcggccaggcggttcagggagaggggttcgccgaggtgttccagggcccaggcgcgggtggcggtggtggtggcgacggtgggttcgggcaccgggcggtcgatgtactgggcctggccgccgtcccgccagggcgggacgacgcacatgcgggcggcgcggttggcggcggcggcgccgtggtcgcggcggatcatgtgcaggcacaggtcgacgccggcggcgacgcccgcggaggtcaggacgtcgccgtcgtcgacgaagaggacctcctcgtcgaccttgacgcgggggtaggcgcggcggaactcgggggcgaggtgccagtgggtggtggcgggccggccgtcgaggaggcccgcggcggccaggacgtaggagccggtgcagatggacaccaggcgggtgccgggccggatgccggcgatggccgcggtgacctcgggcggcagcgggccgccgcggcccagctcgggcatggcgtgcgtgggcgggacgatcacggtgtccgcggcggccagggcctcgggaccggccgcgggctgcacggtgaacccggcgtcgctgaggaccggggcgccgtcggcggtgcagacggtgacctcgtacagcgggcgtgagccggcgtccaggacgctgccgaagacgcgggaggggatgccgagttcgaagggcgggacgccgggcagggcgaggacggcgatgcggtgccgcccggccgcgtcggcgctcgggtcggggcgggggtcggtgcacggccactgcatctcgctcatggccagatcctgtcacatagtggccagacggccaacaccatggtgggggcgggtgccggatcgtggactgcgtcgcgccgggaagggcccgggcggccggtacccgatcaagacggaaaagagtgaggcggacagcatgcgtgcggtggtcgtggagcagtggggcggaccggaggtgctcgtggagcgtgaggtcgcccggcccgagccgggactgaacgaggtcctggtgcgggtccacgcggccggtgtgaacccggtggacttcaagacccgggccagcggggccctgatcgagtggggcgaggtcccggcggtcggctgggacgtctccggcaccgtggaggccgtcggaccgggcgtggggatgttccgccccggggacgaggtgtacggcatgccgctgttcccgcggcaggcgggcgcctacgccgagtacgtcgtcgccccggcccgccacctcgcgcccaagccggcgaacctcacccacgtgcaggcggcggcgctgccgctggccgcgctgaccgcctggcaggccctggtggacaccgccggggtgcgcgccggtgagcgggtgctggtgcacgcggcggccggcggggtcggccacctggccgtgcagatcgccaaggcccgcggcgcgtacgtcatcggcacggccagcgccggcaagcacgacctgctgcggcagctgggcgcggacgaggtgatcgactaccgcacggtccgcttcgaggacgccgtcggggacgtggacgtggtgctggacgggctcggcggccagaacgccgagcgatccctgacggtgctgcgcccgggcggtcggctgatcaccctgcccggccccgacgacgtccccgccgacgtccccggccacgtgcgggcggtgtggatgctggtcgagcccgaccacctgggtctgcgcgagatcgccgccctggccgagcggggcgcgctcacgcccgtggtcgagaccgtcgtcccgctggccgaggccgcgaaggcgcacgagatcggcgagcagggccgcaccaccgggaagatcgtcctgagcgtcgcctgacgccggccgccccggccgggtcggctgcgggcaggtggagcgggaccggagccccgggaccgaccggccccggggctccgggcgcggccgaacgggacggggcggacctgcgggcacggtcggctgctgtgccgtgaccccgctgacgccatgtgcggcgaacagttcgcgggctgcggtcatgatgcgctcacgcttggcctgcttggcccgctcgcggcgcccgaccggcatgtgaccgcgtcccatgggacctcccttgaaactaatcctgagcagactcataattgagtgcaatcggattaatggagtgaggctaggccccatgtcacgccgaattgactgatctggcctcacgcctggataaacaggatgaagacaaggagtagtgccccatgcgagcgttcgtcgtcaccaagtacaaggagccgctgcaagaggcggacgtccccgaacccaccgtgggggagcacgacgtgctcgtccgggtggaggccgccggactgaacccgctggatgagaaaatccgcgccggtgagttcaagcagatcctgccctacaagctgccgctgattctgggcaacgacgtcgcgggcaccgtcatcagcgtcgggacggcagttcgcggcttcaagcccggagacgaggtctacgcccggccccaccaggaccgcatcggcacgttcgccgagcgcatcgccatagcggaagacgacctggcgctcaagcccgcttccatcagcatggaagaggccggctcgctgccgctggcggcgctcacggcgtggcaggcgctggtggagcgcgggaaggtgcggccagggcagaaggttctcatccacgccggcgccggcggggtcggttcgatcgcgatccagctcgccgcacacctcggggcgagcgtcgccacgaccgccagcggttccaacgcggacttcgtgcgcgcgctcggcgcggacacggtgatcgattaccgcagccaggacttcgagcagctcctgaccggctacgacctggtgctggacagcctcggtggtgagaatctcgagaagtccctgcgggtgctcaagcccggcggcaaggccatcgggatcgccggtcccccggaccccgcgttcgcccgcgaggccggcctgaacccgctgctgcgcctggcggtcgcaggcatgagcggcaagatccgcaggcaggccaagaagctcggcgtgacgtatgagttcctgttcatgcgcgccagcggcgaccagctccgccagatcaccactctcatcgaccagggcgtggtgcgtccggtcgtgggaaaggtggtcggcttcgaccagaccccgcaggcgctgcagtccctgtcccagggcggcatccgcggcaaggccgtcatcggcagcagctgacccgccgcaaccgcgacgggcgacacagaacgcacgaggacaccacccatgtctgtcgcctcccagtcggtcggacggcgcgagcggaacaagcaggagaaactcgaccgcatcgtcgctgccgcaagtgaactgttcgccgaacacggcgtcgatgaggtcacgacccagcagatcgctgaccaggccgacatcggcaccgggaccctgttcctttatgccaagaccaagggcgaactcctcctccttgtccagaacgccaagtacgtcgaagcacttgagcagggccgggcggacgccgagaccgtccccggcgtgctggacgcggtgctggcgatcctccggccgatcgtcgagtgcaaccgcatccagatcgacaacggacgcacctacctgcgagagatggtcttcggcgaccccgaggagccccggcacggcgcggcactggccatcgtcgcgcagaccgaggaggccgtcgccgccgtgctgcgccgagacgaacgggtcgcagagggcgacgccgcgacgctggcacacatcgtgtccgccgtgatgttcctcagcatggcggcgagcgtgaacatcgccttgagcgtcgaggagatcgtgcaggacatccgcaggcaggtcgacgtcctgctgcctcgctgaagcgcggccccagcctcaggcccaggcgaccatccgggtagtcctcggctgcagcatggcccgaatccccaaatggcaggtcatccggccgttgctacccatacaaccggcatgactggacgggtggggcggccggccggaggactaccgccaccgcgtgctgctgggattccggaaattgcccacctacgtggcgtcgagtccccgtcgcacagtccctgtccgcaggattccgggtcgaggcccgtgtggtgcggtcagggctttgtgggtcgattcagcagttcaagggcgccttcgacgcgatgatgccgtcctaccgcgtcgtgcgtggcgcaggcggccaggtcggggcgctcgtagggctgccggcagacatggcagtcgtaggtgaccgccccaccactcgaacgccgcccggtcgtccatgggcgcatcacgccagtcccgcctgcctcgcgcgaaccacaggaagtcgaagtacgtgcgcaggtcccggacatgggcggcctgggtgttccacggcgaacgccagccacaccgagaaataccggttcagcgccacgtcgtacacgcccgccggactgatcaggaacggctgcccctcgggcacccccagatcatccaacccctcaccgagatcggcgaacagggagctgaactcccgtgctcgccaaccggtgatcgacatgacgctggacgatagtccgtggacagctcaacagcgcataacagaagtgggacggttaccgcgccctggccggccggtgggccgacggccgtgtcgccctacggagccgcaacggcagcgatctagtgctgtgaccgcgtaggttcgccgggttggatcaggctgcggttgtgagggggcgtccgccccatcgggtgcctttctcgctgcggatgcgggcgcgttccttgcgttcggcggccaggacgtcgcagtggcgggcattggcgttgcgccagcggaggtaggagtgcagggccctggtctggacggtgtggttggggtggtgggagttggcgatggtgaactgccgcagtggtccgaagtgcgcctcgatcgggttcgcccaggaggcgtaggtcggggtgaagcacagctcgaccttgtgcttctttgcccagcggcggatgtcggcgcccttgtgggcggacaggttgtccaggatcacgtagatcggtgcgccgtcgggccgggcggcgcggatcgatttcagcgcggccagcgtgttcccggaacccttcttgcggcggttcacgccccacagacggtcgtcgcccaccgagtagcagccatggaagtaccggacgccgtgggtgcgatggtaggtggccggcagccggtcgggccgggtctgttcggcccagcagctgccgccgatgggccggatcccgagtgggccgaactcatcgaaggcgaatacccggtccgggaagcggtccaggacgtgctcgatacggtccagcttcgtctcccgttcggggtccggggactccttccaggtcttggtgcgctggaaggtgacgccgcggcgggcgagcaggcaccgtaacgcctcacggccgatgcgaatcacccggccgtggactttgcgcaggtaggcgacgagcttgcgcagtgaccagcgagtaaaaggctggccgagcttgaccgggcaggtggtggctgtctggacgacgaagtcctcttcgtcagacttgagttggcggggacggcctcccgcccaccgagggtccaggcaggccaggcccttctcgttgaacgcgtggatcacatcccggacggtgtcctcgtcggcctgcaccagctgtgcgatcaccggcacccgttttcctccagcggaggccagcagcatcatcgcccgccggtagcgcaccgaactcgtgctgccccggtgcacgatctgctgcagcttctgcccctcgtggtcggtcagtctgcgcacacggacgggctcggccaccgcgcctccagcggtcggatcggatgtcaccccacatgcaaccgccacgaccgccgacccggcgaacctatgcggtcacagcgctagctcgcgaacggcacctgtgccgcgggggccgccggcttcgcgaacgggtgctgccacagtccctgtgcggccagcctcggcaggacgccctcgccgaaccagtacgcctcctccaggtgcggatatccggagagtacgaactcgtcgatgccgaggcggtggtactcggcgatgcgctcggcgacctcctcgtggctgccgaccagggcggtgcccgcgcccccgcgcaccaggccgatgcccgcccacagattggggtggatctccagcccggtgggggtcccccctgctcgagcggagtcgagagcttgggggaggccgccgccgtgcagggcgagcatgcgctgctgtccctccgactcgctgcgggcgagcccggcctgcaccgacttgaccgtctccgggtcgaagccgtcgaggagccggtgcgcctcggcccaggcctgctcggaggtgtcgcgggtgatgacgtgcagccggatgccgaagcggagcgtacggccctgttccgcggccagcccgcgaacccaggcgatcttctcggcgacctgcgcgggtggctcgccccaggtgaggtagacgtcgacgtaccgggcggcgacctcgcccgccacgggtgaggaaccaccgaagtagacctcggggaccgggtcggggacgcgcgccagcctggcgtcctcgacctggaggtgctcaccggccaggtcgacggtcttgccctcccacaactcccggacgatttgcaggaattcgccggtacgacggtagcgggcgtccttgtcgaggaagtcgccgtaggcgcgctgttcgtggctctcgccgcccgtgaccacgttgagcaggagccgtccgccggtctggcgctggaaggtggacgccatctgcgcggccagcgtgggcgagacgaagccggggcggaaggcgaccaggaacttcaggcgctcggtctgctgcgagaccatcgcggtggtcagccaggcgtcctcgcaccaggcaccggtgggcgtgagcgcgccgacgaagcccaggtcctcggcggcgcgggcgatctggctcagatacgccaccgtgggcggccggtcccggccggaggcggtggccggggtgccgtggccgccgccgacgacatggcggctgtcgccgttggtggggaggaaccagtgaaaggtgagggacacgtcgggtctccgatcgggaaggtccgccagggccgcgcctgatcagcctggccggccctagagcaggccgtggcggggcggcttggtgccgttgagtacgtggcggccgatgtgctggatcttccagcgggccgggtcgtgcagggtgtgggtgcgcgcgtcgcgccaatgccggtgcagattgagggagttgagggccgagcgggtgccggacacctcgaagagggcgcccgccacctcgacggcggtgctcgcggtgtgcaccttggcggcggccaccgcgagggaggcctcggccgccgagtcgtcggtgagatcggcacgggccgcgtcgacggcacgggcggcggccacgagaagcgcgtccgacgcccttacctggatggcgagttcgccgaatcgctggatcagcagcgggtcctcggcggcggtctcggcaccgctctcgaaccaggggcggcttttcgtccgtacgaactcggcggcctcggccagcgcgcccgcggcgattccggcgtcgatggcggcgtgcagcaactgagcaacagccccgtgcagttggggtccctggaaggtgaggtggtgcgggaggacgcggtcggcggggacggacacggcctccaggcggaccgtgccgctggccgtcgtgcgctgccccatgccgtcccagtcgtcgacgaccgtcacgccgtcggcgtcccgggggacgtacgcgacgtgcaggtcgtcgttctccgctcgggccagcaccgggatccagtcggcgaacagagcgccggtggagtagtgcttgaccccggtcagaaggtacgagccgtcgggccgcggtgccagccgggtgcggatgtcctggacgtgccgggtgcccgcctcggactgggcgttgccgaagcgccgcccggcgagcacctcggcgaagaagaacttccgctgttcctcgatcccctggcggcggatcacattgacgtagacgaagtggttctgcgggatctgggcgaggctggcgtcggccgaggcgagcagccggaagatctcggcgagggtctcctggcgtacgtcggcgccgccgtgctcggcgggcacggtgaccgcgagcagccccgaggcggacagccggtccaactcggcgcgtggcaggcggcgttcggcgtcccggccggacgccccggcacggaactcgtcggcgagcgcggcggcgacggacagggcttcggcgtcgtcggcgatgacatgggcgggcatgacggtcagcccgccgcggccagcaggggcgtgcggcccagggccgccgagaactggtcgaccacctgggtgagggcctcggcggcggccggtgcgacggtgagggagccgtcctcgcccgccgtgatgtccttgtcgagggtgaaccagccctgcactatgtgcgccgcgcccatggagttgagcacggggcgcagcgcgtagtcgatcgccaggacatgggcggtggtgccgccggtggccagcggcagcacggtcttgccggtgagggcgtactgcgggagcaggtcgagcagcgccttgaggaccccggagtaggcggccttgtagacgggggtgccgatgaccacaccgtcgacgcgtgcgaacagttcggtggcctcgacgatggcggggtggcggaagtcggcgccgagcagggcttccgcggggatggtgcggacgtcgagcgggatcacctcatggccctgcgcgaccagccgggtgtccaggtggcgcagcagacggttggtgcgggaggagacggaggggctgccggagacggacaggacggtggccatgggtcctctttcggaacgaggcgttcggggcaagggcggacgacgggcagggggcgacgggcgcggagcgaggggcgcggagcgaggggcagggggttggtgcctggggtgagggggtgccgggggtgagggggcctgcgtgcggcaggcgccccgagcggtcggtcaggcgtgaacggggacggactccgcctcgctttccggcagttgggcctccagctcgcgtacgaggggcagcacgcggcggccgaagtactcgacctcctcgtggtagtgcaggaagccgaggaggaggaggtcgacgccgaggcgcttgtaggcgacgatccgctcggcgatctgctcgggggtgccgatcagccccgtgcggaagccgtcgttgtactggacgaggtcctcgaagctggagtcctgccacatgcccttgccgtcgccggtggactgccccgcctgcttcacggcggcgccgaaaccctcgacggcatcggtgtcggcctgggcgacgatctcgcggagggtctcgcgggcctcggtctcggtgtcgcgggcgatgaggaagccgttgaggccgaacttcggtgccgtgcggccggcctgggccgccgagttgcgtacgtccgcgatctgttcgacgaccccgtcgaagtccttgccgttggagaagtaccagtcggagacccggccggccatcgcccgcgcggccgtggagttgccgccctggaagatctccgggtgcggccgctcgggggtgttgaggggcttgggcttcagggagaagtcgcgcaaccggtagaagtcgccggcgagttcggtgtggtcctcggtccagatctggcgcagggcgcgaatgaactcctcggagcggcggtagcgttcgtcgtgctccagccagggctcgccgagcgcggtgaactcgcccttgaaccagccgctgaccacgttgaccgcgaagcggccgttggagaggtggtcggcggtggcgccgagcttggccagcacgcccgggtgccacaggcccgggtggacggcggcgatgaccttgaggcgctgggtggcgagcagcagggcgaggctgaagctggtcgactcgtgctggaactcggcgccgtaactggccatgtagcggacctggctgagggcgtagtcgaagccgttgttctcggcgaggacggcgagttcgcggttgtagtcgtagccccagtcggtgcgctgctcgatcctgctggtgacgaggccgccgctgacgttggggacccagtaggcgaagcggacgggttctgcgggcatgggaactcccgttggtgcgaatgcgggaatggtgacggagcgcccggcgggtcggcgtgaattcaccgaagcgggcagcgtcagggattcggcccgggccattcggcggggccggaaaaagagccgcggtgggtacgggaaaggaatacgagtcgtatgcgggccgcatgtcagccgtaggccgagcgcattccagccgtaggccggccatccgcagccgtgcgccggccggaagaattcaccgggcggacgggcggtgcgaaggggaccctaccgtcgggatcgtcaggcttcgcgacaacagaaggcgctggagacacgcgcgaggtcgacgtggcgtcgccgcgtgaggtccgttcgcttcttcatgtcgtcgatcgtgacagccactcctcggggcagtcaaggaatacccgaccggtctcgcatcccggaccatggaatttcacgaaggcgtgacaggtaaacccttgaacggcgcgcggcggcggccgcattctgctgcgatgcggacagagcagctcgaatacatagcggcggtcacccggctgggttcgctgcgccgcgcggccgaggaactccacctctcccagcccgcgttgagtgagaccgtacggaatctcgagcgcgagctgggtgtcgacctcctggagcgcaagcgctccggtgcccggatgagcgcggagggccgcgagctgctgccgcacatcatcaatgtgctggacgcggtggaccggctgcgcggcgccgcgggcgagcagcaccgcatcagccgcatggtgcgcctgggcacggtgaacgcggcgaccgtgccgctgctcatcccggtggtccgggagttccgcgcggcgcatccgctgacccaggtggaggtggtcggcgcccagcagtcggagatccaccggtcgttgctggagggcggtttcgacctcggtctggtgaaccatctcgacggggacgacgtggccgccgacttcgagaccaccgaactgctgcgcggacggccggtggtgtgcgtacgaccggacagtcccctggcgtcccggaccacggtgtcggtgtccgacctgctcgccgagccgctgatcgccatgcgctccggttatgtgatgcaccggttcgtccaccggctcctggagggacactccccgtcgttctcgtactccaccgacggcgccgagatgggcaagctgatggtcgccgaggggctgggcgccacggtgctgcccgacttcagcgtgatcgacgatcctctggagcgccggggtgcgatcacctaccgcccgctcgcggacgactcgactcaggtgctgctgatgctccagcggcgcagggcggagtcggtgccgcaagcggcccagggtctgtacgagacgttcgtgggcagggccgaggcgctcggcgggacactgaccggccgcccctgacggcgggaacgcggccacgcgcgggatacggtgcgccgggccgcacgcgacccgacgcgccgaccgaacgcgatgcggcgcgctgcgccggtgtccctctcctgggcccggggcggtgcccgccccctgggcccgggacggcaaccgacgcgtaggcccgggacggcgacccgcccgtaggcccaggacggcaacccgcccgtaggcccggggcggtccccggccgtcgcccgcggggtcggcccggccggtttccgcatgccggtggagcggaggagatcgtcctgggggccgagccctgacccgtgcggtgccggcccggggaatggccggcaccgcacgggtcagtcgtcgtcgcgtccgggaaccaccacgaggaacgcgtccgacttgagatccatcacgaccgtcgcgggctcaccctcggcgcggcgtcgcgccgcgtactcctccgccggccacgatccgcgcggagcacccgcaggaaaccgctccaacaccttcgcgcccatagcggcagcacctccagcgatagaccatcggttcacatcgagacccttgtaggtcccgcttgcccgcgatccgccggcacatgtccccaaaccgcagaagccccctgtcggcgcatccaccccggggcatcccgtggaagggatgaggagaagggcacatgacgctgcgcgagggagccgagaacacatgagcagtgacgacacccggccggggctgcgctgcctggtgaccggcgccacgggatacatcggggggcggctcgtcccggaacttctcgcagagggccaccaggtgcgttgtctggcccgctcgcccagaaagctgcgcgaccatccctgggcgggcgacgtggacgtgatgcgaggcgatgtcacccaccccgagtcggtcggcgaagcgatgcgcggcatcgacgtcgcgtactacctggtccacgcgctcggcacgggcagtgacttcgaggagaccgaccggaagtccgcacgtgtcttcggggagcaggccaaggcagcgggcgtccagcgcatcgtctatctcggcggcctcaccccggcaggcgtaccggagaaggagctgtccccgcatctgcggtcccgggccgaggtcggccacatcctgctggactcggacgtaccgaccacggtgctgcgggccgcggtcatcatcggctccggctcggcctccttcgagatgctgcgctacctcaccgaacgcctgccggtgatggtcacccctagctgggtgcgcacccggatccagcccatcggcgtacgggacgtactgcgcgccctcgtgggcagtgcccggatgccggccgacgtcaatcgcgccttcgacctcggcggacccgaggtgctgacgtacctggacatgatgcgcaggtacgcggcgatcgcggggcttccgcgtcggctgatcgtgcccgtgcccgtgctcactccccggctctccagtcactggatcgggctggtcacaccggtgccgcggtcgatcgcgcgcccgctcaccgagtcgctgcgccatgaggtcgtctgccacgagcacgacatcgcccgctacgtgccggacccgccggggcggccgatcggcttcgacgactcggtccggctggccctgcaacgcgtacgggacgcccaggtgacgacccggtggtcgtcggcgtcggtgccgggcgcgcccagcgacccgctgcccaccgaccccgactgggcgggcggcagcctctacaccgaccggcgtgagctggccgtcgacgcctcgcccgaggccctgtggcgggtcgtcgagggcatcggcggggacaacggctggtactccttcccgctggcctgggccgtacgcggctggctcgaccggctggtgggcggggtcggactgcgtcgcggccgccgtgacgccgcccggctgcgggtcggcgactcgctggacttctggcgggtcgaggagatcgagccgggccgtctgctgcggctgcgcgccgagatgcggctgcccggtctggcctggctggagatgtacgccgagccgggcgccgacggcggcagccgctatcgccagcgtgccctcttccatccgcacgggctgctgggtcacgcctactggtggagcgtgtcgccgtttcacgccgtggtgttcggcggcatggcacgcaacatcgcgcgcgccgcggccaaggacgcgaccgaccgggcgggagcgcacgagcccgcggggtgacaccgattccgggaggcggcggaggtgtccgcgtccgcccggcgaagcggacacgcgtccgcgcggatttccgcgcggacgcggacacggcggcgtgcccggcagagccgcacaggcgcggcacggcggcccctcccggccggctgccgccctgtgcctgtcgccctacgccgctggatcccgaccggctgccgccctacgccgacggatcccgccacggcgccgcacggcggcatcgcgcgccgtccgcaggcccccacctgcatccgccggggcctccgccccggaaacacctggtgccgtaccccccgtaccccccgtactccccgtcccccccgggtcccccccgtcccccagtacctcctcccccgaacccggagcagcgccatgaacgtctcggtcgtcctgttcacctccgacctgcgtctgcacgaccatccgccgctgcgggcggccctggacggcgcgcgtcaggtggtgcccctgttcgtgcgcgaccgggccgtcgacggggccgggttcgccgcccccaaccggctggcgttcctcgccgactgtctgcgagacctcgacgccgggctgcgcgagcgcggcgggcgactggtgctccgctccggcgacgtggtcgaccaggtgtgcaaggtggcggccgaggcggacgccgacgaggtgcatctggcggccggggtcagcgcgtacgcccaccggcgcgagcagcggctgcggtcggccctggaggcggacgggcgtcgactgcacgtccacgagacggtgatcaccgcggtggcgccgggtgccgtcaccccgtcctcctcggaccacttcgccgtcttcaccccgtacttccggcactgggagcgggagcatctgcgcgacgcgctcggcgcgccgcgcggcgtgcgggtgccggagagcgtgggctcggaacggcttcccacccgcacggaactgtccggactgtcgcaggggctggcggcgggcggcgaggaggagggcaggaagcggctcatggcctggctgcgcggcggcatcacggcgtacgaggaccgccatgacgacctggccggcgacgccacttcccacctctccccccacctgcacttcggcacgctgtcccccgtcgaactcgtccaccgggcgcggcggacgggcggccccggcgccgaggccttcgtacggcagctcgcgtggcgcgacttccactaccaggtgctggccgcacggcccgacgcggccaccgcggactaccgcggccgcggcgaccgatggcggtccgaggccgcggcgcgggaggaggtcgaggcgtggcggacgggccgcaccggctacccggtgatcgacgcggcgatgcgccaactgcggcacgagggctggatgcacaatcgtggccgtctgctgaccgcgagcttcctcaccaagacgctgtacgtggactggcgggtcggcgcccgccacttccttgagctgctggtggacggcgatgtcgccaacaaccagctcaactggcagtggatggccggaaccggcaccgacacccggcccaaccgtgtcctcaatccggtcacccaggccaagcggtacgacccggacggcgcgtacgtccggcgctgggtgccggaactcgaaggactccggggagcggccgtgcacgagccctggaagctcaagggactcgaccgcgccgcgtacgactaccccgacccgatcgtcgaactcgccgacggtctggcccgcttccggcacgcccgcggacgcgactgacgccccctttccccccgctcgtgaccgtcttccgtcggcgggccaccgcccgccggccgtcaccggccgtcgaggtcgtgcagcacctcgcgggcggcgcgggcgcccgaggccagcgctccctggaccgagccggtggcacggtgatctccgcacacataccggcccggtgccactcgtgaggtgcggctcagggactgcgggggcgtcatgacgggcagggcgtccggaatcgtacgcgccgtcagcaggtcccagcggccggtgtcgatgccgtacgcctcggccagtgcgtcgcgtacgaggggttcgcggccttcggcgtcctcgccgagaaccgaggtggcgacgagggcggtgcccttcggcgcgtaaccggggacgacctcgctgagcacacaggtgttgaggaagcggcgcccggcatccgtgaggagggtcggttcgccgagcgggggccgcgcggccgcgtggtagtacgtggtgacgacacggtaggcgggcacgtccaggccgggcagcagggacgcggcggggccgggtcctgttgccaccaccacggcatgtgccgggagtacggtgccgtcggtgagtgcgacaccgtcgtcggtgagcgtgccgacgggcgtcccgaggcgcacggtcccggacggcaggcggtcggcgagcgcgcggggcacggcaccgatcccttcggtgggcaggcagagagtgccacgcagcatgctgcgccagaccagatggaagaaccggctggaggtctccagtcggtcttccaggaagactcccgacaggaacggccggaagaagcgctcgacgaactcctcggagaacccggcgcccgccagcgcggaccgcgtggtgtggtcagcgccgcgcttcaacgaccgtacgggggccagcatgtcgcgagccgtcaggatgccgagggccgcgaggtcgcgggggcccgcgagccgccccggcagcagatcggagaacgtgtgcgggctgcgggacgggtcgccgaagcgcagcgccccgcggttcgtgtgcaccagcacccccgcggtgaagggccgcagccgcaggtcccgcagggtcaggcgccgccgtacctgggggtaggacgtgttgaagacctggaagccgcggtcgatgacgaacccgtcgtgacgatcggagcgcatccgcccgccgactccgtcgcaggcctccagcacccgtacggtgtggcccgcctccgacaggtcccgggcacaggcgagtcccgccaggcccgccccgatcaccaggacgtccggggcatcacggatgacggacatggtgatcacctttcatgtatccggccgctcatgtatccggccgcccagtggcttgcgcggacggcgggagcgggacgccgtggcacacgcccctgcacccctttccgggccgcccggccccgcggatgcacccgcggcgacatccgcgccacggacggcgtacgcggagggtgtacgcggagggcctgcgcgagacggcatacgcggatggcgtcaggcccgcaggcgtcaggcccgcgggccgggagcggacggcgtacacgcgcgtgtcatcgggcgtgcgggccgagggcggacgccgtacgcggaccgcgtcagccccgcggcccggaagccgcgccttcgtacgtggcggcgagcgcgtcgagcgcctctcgcagacccggcggtctgagcatgccctgcgccgaacgccccgcccacccctggccgcccagcatcaccagcgggtgcctgcgcgcacccttcacgccccactgcgtcgcggcgacgtgcctggccagcgggaggctcgccgtggagcgcgcctgcgcccacagcaccacggccgccggacccagccgccgtaccgccgcggtcagcgcctccaccggtacggccgcgccgaacatacgggtgggcagaccgagttcgatcagtccggcgttgagcgcctccagcggcagcgtgtgctgttcgccggggacgcacgcgaggaccacgggaccggcggcgtcccggtcgccggggcggacgggcgcaaggacccggcggagcgcggtggagatgtgccaggacagcaggtgctcgacctcgacatagcggtcaccggacgactcccacttgcgtccgacggcgtgcagcgtcggcaccatcacctccgcccaggcgacggtgaggccgtgccgctccacggacgaggtcagctggtcctcgacggccggggcgtcgagccgcacggcggcccgggccagtccgcggcactcctgacgcacgtcgccgaggggcagcgtgccgcccgcgtgcgagcgtacgcggacggcgggcgccccggccgcctccggctgagcgggggtgggcgacgacgagccgccgccttccttggccacgcgcgccgcctcggcgggcggtactccggccgaggtcagccggcacatcgtctccagcatcgccacgtcctggggcgaccagcggcggtggcgtccgtcggcacggatctggggccccacgccgtatctgcggtcccaggaacgcagcgtcgttggtgacaccccgagccggcgtgccagggctccggtcgtcagcccggtgtcgtcgacggccgcggtaccgggccggagcccgcccggccggccttccgcgcgcgtggactcgctcatgagccgactatacgacgcacaaacgatgcgagttgatggcctcgctgcccacctcggacgatggtcacaccggggcgaaccgccggaaacgccccggtgaccggcaccccgggccgcgagagcggtccggccgccccgcgtacgaccgggtcgggttccgacccacacgaggagcctccgtcatgaccgcacagccgaccaccgcacacgcgcgagcaacggacgtgcccctgtgggtgccggtggaggagtcgctcgcggacgaggaactggcccggggcctgatgaacggcgacgaggcctgcctgaccgccgcctaccaccggtggtcggcactggtacacacgctggcccggcgcaccctgggcgacgtcagggaggccgaggacgtcacccagcaggtgttcctcggcgtgtggcgcggccgtgcggcctaccgaccggagcgcggtgccctcggcggctggatcgtcggcatcaccagacggaagatcgccgacgccctggccgcgcggacccgccgccgcgacctggtcacctcggccggttcggtcatgttgctcgccgacggcgcgggcgaactgccggaggcggccctggaccgggtgctggtccggcacgagctggctaagctgcccgcgccccagcaacaggtgctccggctggccttcttcgaggacctgacccagacgcagatcgcccggcgcaccggctggccgctgggaacggtcaagagtcatgcccggcgcggactgcgccagctgcgccgctgtctgcaacaggaggcgaccgcctgagcagccgccgacgaacccccacgcgaggcccgaaccatcattcgatgcacaaacgctgcaattcgcgcgcggccccgcgtccgtcggagcgggccacgcgtcgggccggtcaccgtttcctctccgccgccgcctcacgcaccgggctgtggctcctgacgatcgcggtggcagtggcggtggcggtggcggtcggcttcgtccggcgtcggcgcctgcctcgacgtccggtgccgagcgggtgcatccgatcgccccaccttcctggaagcaggggtcgtaacgccgtacggctcgcccggcggccgacgaccggggcccggtccccctctttgatcacccctcccggggttgtcggcaatcccgggaggggccttggtcggcctccccgcgatcccaggtgcgcagccgcggcagaaccggcggggtgccgatggccgatccgggtacggtctcagcgggtcggggctgagccggcccggtcttcccggtgtacgagccgggtgacccgtacgggcacatgagcgaagggcagccgtggaacggcatacgtcggtacccgccaggagactgtcatggctgcgccgtctgccggccctggcaacgggaaccggccgcgcgacaggccccgtccttccttcgggtgcgcccgcggcaccgcacggcgtcacggacgtaccaaaggcccgtgtgcacgggtcctggcgggtccggcgggcggcgttgcgccggaccccggtgtcgatgtggcgggacgacgtgtccgactgggcggcggcattgacgtactacgcgatcctcgccctgttgccggccatgctgatggccgtctccctgatcggactggtcagtccccgcgtcaccgacgacctgatcgcgcatgtcaccgcctgggcgcccgcggagtcgggaaacaccctgcacggctcgctgcgccacctcgccggtgaacggtcggccgcgctgaccgtggccatcgggggtggcgtcagtgcgctgtggtcggcgtccagctacctggccgtgttccggcgcgcgctgcacgcccagcacggcatcgaggacacccggcccgcgctgcgcacggcgccccgcattctgctgacggccgtgaccctgctggcgctgctgttcgtcagcgccctgctgctcgtgctcagcggttcgctgctggaggcgctggggcggcgggccgggctgggcggcgccggtgccgccgcgtggacgctgctgcggtggccggcgctgctggcactggtggcgcttttggtgctggtcctgttccgcacgggtccgcgggaggtccgcgagctgcggcacgccctgcccgggggcatgctcgccgcgctgctgtggctgaccgcgtcggcgggcttcaccgcgtacgcctccggtctgggcgcctacagcaagctgtacggatcgctcgccggcgtgatcgtcttcctggtctggctctgggtgtccaatctggccctgctggccggcgcccagttcacggccgagctgacccgagcggaacgtgccgcgcaagctcccagggatcgtgggcgctgaagacctccacctcgtcgccgtgccggcgcaccaactcccgcaggcgggcgtggttgccgaggcgcaggggccggtccacctcggtgatctgctgaaggatgtccatgccggggtgcccccgtgggtcgtcggggtcgatctcgcggtggaagtagtaggcgtcgccgcagtgcagcagccagcgcccggtgtcccggacggcgatcgcgctgtggcctcgggtgtgaccgccgaggggcacgagcaggatctccgcgtccagcccgtccagcggccggaccgcgtcgaagccgaaccaggggtcgccctgggcttccggatacgtcacccagtgcgggcggtgcgcccactgggcggggcggtagcggacgcggtcctcggggtgggcgccgggcgccgccatcgcggcgcggtgttcggcctcggtcaggtggaccttggcccaggggaagtcggacagacctcccgcgtggtcgaggtcgaggtggctgagcacgatgtgccgtacgccctccggccggaagcccagcccggtcacctggtgcagcgcggtctccgccaggtccagcacgggctgggcccggccgaggaagtccgcgccgagattctgttcggggcgcgccacgtcggccgtgccgatgccgctctcgacgaggacgaggccgtcacggtcggtctcgacgagcaggcagtgacacacggcgggcaggctccccgcgtcggtgtcgatggttcgcatggagccgcagttcagatggtggatccgcacggttgtttcccctttgcgccgccgggtgttcgctcggctcaccagttttagctaacgatcgttcgtaagttattagcgaacggtcgttaggttaaagtggtcgcatgagcccgcgcaagtccgttgccgaagccgccgccacccgcgaccgcatcatcgagcgcgccttcaccctggcctccgccgagggcctcgaaggcctcaccatcggccgcctcgcgaccgacctgggcatgagcaaggcgggggtgatcggtcacttcggcaccaaggaagcgctccaactcgccgtactcgaagcggcggtcgaccgcttccggcaacgggtaccggggcgcgcggtgggcgcgcggccgggcaccgagcgactgtcgcgcgcgctccacgagtggatcgactacatgaccgagagcgagggccacgggggctgcttcctcacctccgtggcgagcgagttcgacggccgccccggcccggtgcgcgacgcggtgctcgacgcgctgtcccgctggaccgcttacgtcaccggggagttgagcacggcggtcgaagccggccggctgccgccgctgaccgatgtcgaccagctcgccttcgagctgaacggggtgatcctcgcggccgaccagtccatccagctgcaccgcgacccccaggcccccgaccgggcacgccgcgccatcggccgcctcctgaagcgctaggccgcccgcgacctccgtctccgcaaccccgccaaccgctacacataaagaagaaataagtgcagaatgggcatacgtggcgcttaccgcacattccccagacgcggtcaggcctgcagagttcaaaggagacgactcatggccaacgtctcgcacaccagaggtgacatagccagccaccctgatgtaccagaaatgcgggaacgatacgcccgcatgctcggtggtcgcgatgtggtgctcgtcgacggaccggtgttcctgctcggtctgtactgcgccgcatccccctggatactccactacacgacaagccagcccgcgctcgcgacgcacaacctgatcatgggcatcgccataggcctgctggccctcggattcaccagcacaccggagaggatgtacggcctgagctgggccatgtgcgcgatcggcgcatggatgatcatctcgccgtggatcgtcggcaccagcccggacaccggagtcgtgctcaacagcatcatcatcggcgtcctgaccgtggtgctgggagcactgtgcgcggtcacgacgacgaggaacacgccccgcacgtagccacggagccgggtggtgctcggagcgagtccccgttggtacgggcagcacgaaacgggcacccgtcggccggtccgcgccccgcggaccggcctcggcctgtgaccgtggccgtggccgtggccggcccaaggtcccactgaccatgaagaagctcgggtcaaaggactgaccgcgacaagaggacggaccgcaataatcggtcgcgtgggaccgcatggccgatcacactgtcgcggtgagtcgaaccgtcagcgcatgggtgacatcgggtgcggacttcctcggtgtcgccggcccctttcccgtggatgtcccgtggtggtccgaggccgagcaggtcgtcggggagttggccggcctgctcggggtcccggtactggtactgcggctgctgaccgtggagggcggcgacggcgggcgggacggccatgtgacgtaccacgtcgaagcactgggcagccccgcaccggggacgctgcgccaactgcccgtcgacgatgccctgttgcacggtcacgagtcgctgcgctcgccatgggcgcgagccgagggcctgcgggagctgatcgactgggcgtccgggacgctgcgcgacgccgggcggcccgtgaccgggccggtcgagcagcggcggtcgtggaacctggccggcctcttccggctgcccaccgaggacggccggttctggctcaaggccaccgcgcatttcgccgcggacgagggcgcggtcatcgccgcgttcgcccgggtcgacccgggtttggtgccgacggtgctgggctcgggccaggggcgcatcctcatggaacacgtaccgggcgaggactgctggggcgcctcacccgagactgtcacggccgcgacggagcggctcgtggcagcgcaagccgccctggcgtcgacgcgcccggccgccctgcgggactggcgcgcaccggccctggccgcacggatcgacgtgctgctcgacggcccggtcgcaccggacctgacacctcaagagctgtccgcggcacgcgcactggcggaccgctgggccctgctcgccgagtgcgggctgcccgacaccgccgtccacggcgacttccatcccggcaactggcgcagtgacggcggctcgccggtcgtcgtggacttcgccgacgcgtactggggcaacccggtcttcgacggtctgcgcgtccacgaattcctgcccgagtcggcacggccggcagcggcccgtgcctggatcgccgcctggacccggcactcccgcggaagcgacccggcccgcgccctcgcgatcgcggagccgctcgcccatctcgccctggcggtgcgctaccaggagttcctggacggtatcgaaccgtcggagcgcaggtaccacgagggagaccccgcggcggaggtccgcaaggcgctgcggtgcgccgaggcgcccagtccgtacctcgcgccggccgcgagcaacgcagaccgctgaaacccctgggccccccgcccccgttcgccggcacagcaggatcgacacacggacggccgcgaggtgttcggctcggcgggcccgcgaggtgttcgccccggcgggcccgccgtccgtacggcgaagggatgcgacgcgatgctccaggcgggttccgacgtggcgctccacgccggtccccagggagcgtgaccggcccgccccaccccggcgggcccgacccgcgcacgggcccgcccctccgttcaggtctgcgccggctccgcgtccgcgtccggagccgctgccgtgaggtactcctccgcgatctccctggggccgaacggccagaccttctccaggcgcgcccacacgacgaaggcgacacagccgagcgccacccaggcgagtgaccattcgatggggtggcggcccggggagttcttgtcggcgtacccgtagatgaccagccagcccaccagggcgatcacactgggcagggggtagagccacatccggtacgggcggcgcagggtcggctgccgcttgcgcaggacggtgagggcgacgatctgggccagcgcctgcacgatcaccatcaccgtggtcaggagctggatcagcgtggccaggtcggtgtgacggccgatcaggaagccgatcgccgtgatgacgcccatggtggccaggcccagcatggggaagcggtgcctggagtggagcttggcgtacgggcggaaaaagacgcggtcgcgggcggcgtcgtacgggaccctggagccgcccagcaggccggtgaagaccgaggcgaaggcggtgatgaggatgaggaccgtgaccgtgtcggcggcgcccttgccccaggtcttctccaggacggcggaggccacggaggtggaggcgatgtcgcccgcgtcggtcatccggtgccagtcgatgacgccgagcgtgccgatctgcagcagcaggtagatcgccatgatgccgaggatggagaagaggatcgagcgcggcagggtgcgccccgggtccttgatctcggcgcccatgtacgcggtggtgttgtagccgaggtagtcgtagatgccgatggtcaggcccgcggcgaagccgacccagaagtggccgctggtcggttcgaaggcgtgcgccggataggtgaaggccaggtgcgcgctgaagtcgctcgccgcggccacgatcaccagcaggaccgaggcgatcatcaccgtccacatcacggcggtgatccgcgcgatgttctcgatgccccgccacagcagcatcaccaccagggcgatgatgcctactccgaccaggtcaccggtggtccggcccatgtccggggccaggtagccgaggtactgcacgaaaccgaccacacccgtggacatgatcagcgggatgaagagcatcgccgtccagacgaacaggaacggcatcagccgtccggtgcggtactggaaggcctggcgcagatagacgtagctgccgcccgaaccgggcatggccgcgcccagttcggcccacacgagcccgtccgcgagggccagcaccgcgcccgcgacgaagccgatcaccgcctgcgggccgccgaacgcggcgaccatcagggggatcgtcacgaacggaccgatgccgcacatctggctcatgttgatcgtggtggcctggaacaggccgacacggcggacgaagccaccctcgggcggcggactacctgggctaccggacatcggtcctcctggagcagggcacgggggcagtcgtacgacgtgacggccgacgtcgatcggcggccggcggatcaagggcggcgggtgtccggccggcgccgggctcccctcggctcgcccggcgaggctgactggccgataaagttaaggagccttactagatgcgtcaagcccgtgtcatgaatgcgtgagaatggtgcgatgcccgccagtgatgccgcagaccagccggaacagccatggagccgtcggcggctgcgcagcaccaacgagcggctgctcctcgaccggctgcgggccaccggcgccgcgtcccgcgctcagctcgcccgcgagacgggtctgtcgaagccgacggtgtcgagcgcgctggcggccctggaggaggcgggtctcgtgcacgaggtcggcacgcacgcaccggagcggggccggacagcggtcctgtacgcccccgatccggccgccggacacgccctgggcatcgacatcggccgcagctggctgcgcgtcgcggtcgccaatctggacggcgaggtggtggcccgcgccgatgtgcgcaaccgggcccgcacttccggcgccctggccgacctcgtggtcgccaccgcccggcaggtggtcgccaattccggtgtcgggcacgacgaggtggcccacgcggtggtgggcacgcccggtgtgtacgacgaacagcggcggcgggtgcggtacgcgatgcacctgccgggctggggccgggccgggctgttcgaccggatgcgcgaggagctgggcataccgctggaggtccacaacgacgccaatctggccgcgctgggcgagtacacgtacggcgtcggcgcgggcagccggctgttcacgtacatcatgatcggcaccggtctcggcatgggcgtcgtcagcgaggggcggctgttcaccggcgcgcacggcggagccggcgagatcgggttcctgccgtggccggggcagcggaagccggagacgttggaggacgcggtgtcgggcgtggccgtcgtcgagtccgcgcggcggttcggcatgagcgggcagctcacggcgaaggccgtcttcgacgcggcacggcagggaaatccggcagcggtcagggccgttcggctggagggcgagcgaatagcgcacaccgtggcggcggctgcggccgtactggaccccgacctggtggtgctcggcggcggcgtgggccacagcctcgacctgctgctgcgccccgtgcgcgagacgctgcgcacgctcacgccgctgcgcccgaagatcgtgccgagccggctgggcgaggacgcggtgctgctcggcgcggtggcgacggcgctggggacggcccgggacgtcgttttcgagcgacgctcggcctcctgacggtgattgacatgaattgctcagccacctagcttgtgaatccagttagtaaagtttcctaacttgcagtgtcgtagcgcggatgctcctcccccaccccccaaggagatcaccgtgttccaccgtcctgcctcagtacggcgcttcgtcacgaccgccgtggccctgggcctgctgagcacgctctcgacgggcgcccgggccggagcccgcacccacgagccgcccccgcgcccgaccactgtctcctcgactgcgggcagcaccaccgcgctgaccggctacgcgatccagtccacggcgaaggtcaccgaccccgcggccgccgtctcctcccccggctacccggcgagcggctggtacccggccggtgcccgctccaccgtgctcgcggcgctgctggccggcgggaagtacgccgacccgttctactcgaccaaccagcagaagattccgaaggccgacttccaggtgccgtggtggtaccgctcggacttcacggtcgccgacacctccgcccgtacgtatctggacttcagcggggtgatctcggcggccgacgtcttcgtcaacggacgtcagatcgccaggtccgccgacgtggcgggcgcctacacccgtcacgaactggacgtcacctcactggtgcgggagggcgcgaacacggtcgccttccgtatccagcccaacaaccccaacaagaacctgaccatgggctggatcgactggctcgagccgccgcccgaccagaacatgggcatcgtccgtgatgttctcgtgcgccgcggcggcccggtcgccctgcgcgacgcccacgtgatcacgcggctcgacgtgccgtcgctcgccaccgcggacctgacggtcaaggcgcgggcccgcaacgactcggacgcggccatcaccgccaccgtctccggcagcgtcggcgccacgtcgttccgcaggtccgtcgctctcgccgcccacgagacgaagacggtcaccttcacaccggccgacactcccgggctgcacctcacctcgccgcgggtgtggtggcccgcgggcatgggcggccagcccctgtacgcgctggacctcagcgcgtccgtctccgaaaccgtctccgacacggtgcacgagagcttcggcatccgggatgtgaaggccccgctcaactccgacggcgcacggcagtacagcgtcaacggccgcaggcttctcatcaagggcggcggctggtcgccggacgagttcctgcgctgggacagcacgtacgtcgaggaccggctccggtacgcgctcgacctcggcctcaacaccatccgcctggaaggccacatcgagccggacgagttcttcgacctggcggaccggtacggcatcctcacgctgccgggctgggagtgctgcaacaaatgggagggcaacgtcaacggcagcggatccggtgacgagtggaccgcggccgactatccggtcgccaaggcgtcgatggccgccgaggccgcccggctgcgcgaccacccgagcgtcgtctcgttcctcatcggcagcgacttcgcccccgacgcgaagatcgagaagacctacctcgacgccctgaaggcagccgactggccgacccccgtagtcgcggccgcctccgacaagtcctcgccggtcagcggcagttcgggcatgaagatgaccggcccgtacgactggatcccgccgaactactggtacgccaagcgcgagggcggcgccaccggcttcaactccgagacgagcgcggggccggacatccccacgctcgacaccctgcgccgcatgatgaccccggccgagctggacaccctctggaagaacccgggcgccaagcagtaccaccgctcaccgtcgtcggtcttcggcaccctgaagatctacgacgccgcgctcgccggacggtacggcgccccgaccggcctcacggactacgtacgcaaggcgcagctcgcccagtacgagaacgtgcgcgcgcagttcgaggcgtacgggcggggcgccaccgacgcctcgaagcccgcgaccggcgtcatctactggatgttcaacagcggctggacctcgctgcactggcagttgctggaccggtacctcgaccagggcggcgcgtacttcggggcgaagaaggccaatgagccgctgcacgtgcagtactcgtacgacgaccggtcggtcgtggtggtgaacaaccggcccgccgccgtctccggactcacggcccgggtcaccctcttcaacaccgacggaacgcagaagtacgacaagagcgcgaccggcctgagcgtggccggcgacggtgcgcacagcaccgcgctcacgctgccgtcgtcggtgagcggactgtcgacgacgtatctcgcccgcctggtcctcaccgactcggcgggcaaggaggtcagccgcaacgtctactggctgtccacccggcccgacaccctcgactgggcgcacaccgactggtactacacgccgacgacgagctacgccgacctcaagggcctcggctcgatggcgcgggtgccggtctcggcgacggcgtcgacgacggcgggcacggacggcgcgtccacgacgacggtcacggtgcggaacacgggaagcggcaggaccccgtcactgttcacggacgtgcacctcgtcgactcgaaggggaagcccgtcctgcccgttcagtggtccgacaacgaggtgagcctgtggccgggtgagtcggccaccctcacggtgacgtaccggacggccgatctgcacgggtccgcgcccagggtgcgggtctccgggtggaacacggcggagcagaccgtcccggcggcctagccggggcggcgggacggggaacgcgggacggggagcggcgggccgggtgtgtgggcccgccgctcttcgtcggccggttcagctcacggtgagcgccgtgtcgtcgaggacgaacgacgtctggagcgtggagccttcggtgccggtgaacttgacggtgacggtctgcccggcgtagctcgcgaggctgaaactgcgctgcgtgtagccgctcgccgcgttcaggttcgagtaggtggcgagggtggacaggaccgtgccgccgctgttgagaacctgcgccttgagcgtgtcgtacgccgtgctcgtggtcgtctcggccgtgtccacgtggaggtagaaactgagggtggccgtggtgcagccggaggggatggtcaccgactgggacagggtgtcggtgcgggcggagccgtatccgtcgagccaggcgtagtaggagccggtacgggcggactcgccgctggagttggtgatgacatcgctgctcgcggtccaggtggtggcgccggactcgaagccgttgttgccgaggagctgggccgcggtgcaggtgccgccaccacccccgtcatcgccgccgctgctcgcgccgaccagccattcggtggcgttgagggcgagggcggcgttggtggcgccggtgtcgttccagccgtcgtacaacgtgttgccggactggccggtgccgtcgtcgatcggtgagctgtcgccccagaacgcgacccgcccgctgccgaaggtgctggtggcgaagaaggctccggtgttgccggagtatccggtgcggtagagcagccccttgacggacgagttgtcggcgggcttgagggtggccgtcgtaccgctggcgatcaggctcttggtgacggtgccgaaggagccgtgcaggaccgcgtcgctgctgtcgctgatcgccgacgggtagtcggagctgacgctcagcgagtcgatggagaagccgaacgggtcggtgctgtcgacgctgttgtcggtcatcaggtcgttgaggacctcgaccgcgtcgtagccgtcgttgttacggtcggcacccgtgtggtcggagaccatgaacaggccgccgccgttcttcacgaacgtcatgatcgcggtcttctcggccgtcgtgaacagcgtgttcggctcgggcaggaccagcgtgtcgaagttcgacagatcggtggtggtggagccgccgtagctgaggctgctgcccgaagggagcgtcttcaggctgtagttgccggtcttctgcagggcgacgccccaggaggagagcgcgcccgtccagtcggtttccgaggacggggaggagtcctggccgagcgggtcgggctggctggtggagacgatccagtcggcgttgccggccgtctccgcgtggccgttgtcgaacaggacgcggtgcgtggtggccgcgtgggccggggcggcgatggacgcctggacggccgcgcccgtggcgagcagtccgaacacggccagcgccgtggtgagtctggggcgggatcttctgaatccgagcatccggcgaacctccgtgacgggtggggtagaggcagtgcgggagccaagtctgcgcgcgtagattggtagttgaccgtcctacgtacgacagatttttgaacggtacatgacatgagtaacggtgaacagcgaccctccccagaagatgccgggccggaatcggaagggactgcctccgccgccggagggaaaacacatagcagcggggctttcctacgaagaggggcggagatggagatctcgggcatcatcagtgccatcgtgatcggcatcgtcatcggcattctgggcaggctcgtcgtcccgggacgccagcgcatcggcatcctgctgacgattctcgtcggcatcgtggcggccttgatcggctccgcgatcgcgggcgccttcgatgtggccgacacgaacggcgtcgactggatcgaatggctcatccagatcggtctggcggcgctgggcgtcgcggcactggaccggacacgggctcgccgctgagggctggggccgtcgcggagccgcagacctggaagccagggccgagggacggggcctgaggggcgggccgtggggcgggttcttgggacggggccgtgggcgcggcacgggactgcgccgaggcgcacgcagcccggcccgtcgctccgccgcaccggtgctcccctttcctccccgtgccaaattgcaggtcaaccgccgtggcggctacgttctgcgggcttcgccccaccgtccgcctccttgtcgccacggagagaccttgcctctgcgcctcacccccctgaccgatcccgaaccgaagccgtcgagccggcggctggcctggctggcctccgacgacgacggcgtccccgtggggtcggcctttctccggttgttcacgaaggagggccaggagcatctcgccgagctcgaaggcgccgtgcaccccgaggagcggcggcagggcgtgggcggccgcctgctcgacgcggccgtcgccgccgcgcggggcgaggggcgacggtcgctgatcgcccaggcccaggagggctcccccggcgatcgcttcctcgcggcgcgcggcttccgccgggtgctggccctgacctacgcccgactgccgctggccgacgccgggttcgaccgtatcgccaagatcgtcgaacagccgcactccggctacgagttgacgcgctgggacggcacggtcccggcccgtctcgcgcagaccttcgccgactcgcggcgcgcgatggacgacatgccgatggaggacaccgactacggcacggtcgcctgggacgtggaacgggtcgtggccgcggccgcggcgatcgccgagcgcggcgaactgctgcacacggtcgcggcggtggactcgacggacggctcgatcgtcggattctccgagctcgtggtgccgggcgacggtcggggcgacgctcagcactacggcaccggcgtgctgccggagcaccgcggtcacggtctcgggctgtggatgaaggccgagtcgatccggtacgcccgcgagcggcacccggaactcgccggtctgctcacggacacggcggacagcaacaccccgatgatcgccatcaacgactcgctcggctaccgtcccacgcacacggcggtggagtaccagctggagctgtgagtccgccgcaccgggaagaggccccgggacggcgcgctcagggcacgccgtcccgcaacgcggccggcccgtcccgcgtcgacgcgacggcaggggccgcgcccagctcgcgcggcgatgctgtgcggctcacggcgagacgtacggtgtcgtggtggtgaggggctcgaagccgagccgggcgaggaccgggcggctctggctggtggcgtcgacctggacgtagcgatagccacggtcggcggcgaccttggcgcggtgggcgaccagggcccggtagatgccgcggccgcgctcgccctcgaccgtgccgccgccccacaggccggcgaagcgtgtgccggggacgagttccatccgggccgcgctcaccggttcgtcgccggccagggccacgacggcgacgaccgcgtccggatcgtccgtgacctgggcgagcagttggtgccgcatccgtgtgctgtcggtgccgaaggccttctcatggacgtcggccacgaggtcgacgcccgcccggtccgtcacgggcacgatgcgtacgccgtcgggcggttcgacgtcgagggtgaggtcggcgacctcggcgaccatcagggtctcctcgggcgccgccgtgaatccggccgcccgcagccgccggccgaggtcctccggcaggtcgtggccgtacagcttccactcgaactcgcggccgagcccggcgaagtagcgctgctgctcggcgatcgccgcgtcggcactcgcctcgtccaggccggaccagacgacgccgttccagccgtgttcggaggcgacctgccgcaccacgccgggcacacgctcgatccgggcgccgggcccgtccggccgcgccccttcccgcatgtcccggtcgaacagggcgagtaccgcagcgtgatccatgcgctcactccagcatcctggggcgtactcggcaatggaattcccggagcaatcgccgtgtgcggcatgtcggttgtgccccggcgtcggatcgtggctcaggctccggtgtccggccgcaccgccgccaggtaggcgcgaagccggtcgcggttgcgggccaggcagtcgatgcgggcctggatacggtcgatctcgccgcgcaggagggcggccgtctgcggggtcagggagtcgggagcgagggatggtgttcggggtcgccacggtcgccgggatctggaccgtcggcgccctgatcgacgcgcacctgcgccggaccctgctgtgcgcgctcgctctgatcggggcgaccctgctcgccctcggccggtacgcggaccggccggccgtgctgctgatctcggtcgcgctgtggggcgcggcgttcggcggggcgccgacgctgatccagacggccctggtcgacgcctcggggcccgccgacgcggatgtggccacatcgctgcagaccaccgtgtacaacgcgggcatcgcgggcgggtcgctcacgggcggcctcgtgctggacggtgcgggggcgggggcgctgccctggaccgcgctgcccctggtcgcggccgcactcaccgtggtcgccctgggccgccggcggggcttcccggcgctgcgcccgtccgacgacgcgcgctcctcggggcaagggccgagccctgcccgtggctgcacaccccgctcggggaactcacggtcaccgcgaccgccgccggtgtcgtgacgctgctgtgcacgggaccggtccgcgccgtcttcagccgtgtcgtcgagccgcgcatggagtgggcgttccgcacccggacgacgacgccggtccggggaggccccgcgggcacactgaccggccgcacctgtcggcggccggtcccgtgcggtgccatcgcgtgcgtccggggatcagcccgggtccgggctgatcccgaaaaggcacgccctagccgagttccagcgaggtgatcccgtacacgcggtcggccgcgaacggccgcaccggtccggtgtacatgcgggccgtctcgaaggacggcgtcagacccgcttcccgggccagggccacggccgccgtgttcgtctcggggatgtccatggcgatctcgcccgcgtcggcggtcagcgccgtgaacagggcgcgggcgtcctcggcggagtcggcgaacagggggccgacccgcagggagtcgagggccggacgaaccacgccgtagccggtgaggcggccgtcgacgaggcggacgaaggtgcggtggccggggccggccagccagtgttccagaaagcgcgggcggtcggccggggagcaggcgctgtcgtacgccgcgacggcggccaggtcggccgcctcggcggggcggactcccgaagccggctcggccgccggaacggttccggtgtaccgggcggtgcggtgggcgagctcgaaaccggactgccggtagttgtcctgctgcgccggcacgccgtccaggccgaccgtgcggtcgccggcgtgagcgagcgccgtcttccaggtggtcaggccgtagccgcggccccgcaggtcggggcgtacgaggtagaaccccagaaaggcgtagtcggcgccgtaattgacgaccgagatcgccgagaccggttcgccggcgatccggccgacgaagaagccctcggggtcctgggcgaagaagctgggggcgtcggacagccccggattccagccctcgtccgccgcccacccgacgacgacgggccagtcgtcgagcgaggcctgggtgacgacgaggtcatcgggacccggagaggtcatcatgcgctccattccgtggcgggtcgcttgcgtgcggtggtcggccgctcccgcagcatccttcccgatcacgcggacccgcgccaacgcgacaccgggcgggcatgagcaacctggcttgtccgcaacggtgttgagcgtcgctgtaggcgaggccatgaggcatgagcatcgatcacgtgacaccgcggtgcgcgtggccccgcatacagggcccacggccggtcaaggacgtgggcccccgttgcgggccggtcggctcagcgccgcgcgccggcccggaagcgccggtacagcaccgccccgcccagcagcagggccgcgctcgcggcgacggcgggcacggtctcgtccgcgcccgttcgagccagggaggccccgggtcgcgcggccgtgttcgggagggccggccgtgcgggcgcgggcgccttcggcggcgcggcgggcttcggccgggcgtgcccggggtggtgggggtggtggggccgcccgccggatgtgttggtggactcgttgccgacggccgcgttgccgacgccgaccacgttcacggtgttgccgctgacattgaccgggagatggaccgggagctgcacactgtttcccgaaaccacccccggagaatcctttccgcttccctgggcggacgcgcccggggcggcagcgcccccgtcggcggcgcctcccgaaggactgccgtgcccctcgttggcgcaggcgttgcccgctgccgggttgaggaacccgacgacgttcgcggtgttcccgcacacgttcacggggacgtgcaccggcagctggatggtgttgccggagaggagcccgggcgagcccgccgcgctgccgtccgccgcggagtcggcgtacgccggcatgaccacggccaaggcgcccgaggcggcggccgcagcgatcaatccattccgggtaacccgtttcataggttccctgccttccagacatggtcgcgggcactcgcccgcacggggtaaaacgcgggcgaaccatccgagttatggcttatccgtctttcactccatcgagcggcacggttatcgaactggtggttgtcgtgccggaggggtgatcaccgggccggaccgggcggcgctcgggacaggaccggccgggcccggcccactcgcccagaggcgggctcccggacgcccgattatcgtgatcagggggtgtccccggtgcgggcgtacctggaggcgttcatgctgtccacgcacaggcgctgcgcggtcgccggcgcggtcgtcgcggccgcgtcgaccgcggcgctggccctgctgggggccggtctgccgtcggtcgtaccggccgccgacgaacccgatctgtcccgcttctacgcgcagaagatcacgtgggccgcctgcaagggcgacggcatgcccaaggacctccagtgcgggaaggtgaccgtgccgctcgactacgcgaggcccgacgccggcacgctcgacgtggcgctggcccgctaccgggcgacgggcaagtcccggggatccgtactgctgaacttcggcggtcccggcgcggcgggcatcggcgcactcgccggcgacggcaacgacttcatgggcctcaccaacggctacgacgtggtgacgttcgacccgcgcggggtcgggcagtcgtcccccgtcagctgtggcgaagggagcaccgaggccttcgccgagctggacgcgagcctcgacaccggcgatccgcaggccgccctcaagcagttgcggaaggtggccgacgagtgcgcgaagcactccggtcccgtgctgccgtacataggcacgatcaacgcctcgcgggacatggacgtgatgcgcgcggcgctcggcgacaagaagctcaactatctgggcttctcgtacggcacacggctgggcgcggtgtacgcggcccagttcccgaagaaggtcggccggatggcgctggacggcgtggacacgctcaccgagccgctggccgagcaggggctggtgagcgccgagggccagcagaccgcgctggacagcttcatcacctggtgcgtcaaggacatcgcctgccccttcggccaggattcgcgttcggcacggcagcaggtcgtgcggctcgtccagtcgctggaccaggaccccgtaccggcggacttcggccagcagctctcggggcaggatctggtgggcgccatcggacaggcgctctacagcaagcaaatgtggcccaccctggaaggggcactggccaatctcgtgcagaacggcgacgcgagcggggtcctgcgtctcgcgagcggcggcatggccatgccggatctgccccggacgggcgaccggccgtccggccggccgagccccgggccgagcggcgggctggtcgccccggcggacgtgcccgtcgacaacccgtcggccgcgctgatggccatcacctgcgcggacacccccgaccggcccaccgccgaacaggtcacccgggacatggacaagctgcgcgcggcctacgaggaggcgtcgcccgtcttcggccggtaccggctcaccgaggtgctgatctgctacggccgccccaagggcacggacttcatccgggacgaggtgcgtgccgtcgacaccccgaagatgctgctcgtcggcacgcgcggcgacccggcgaccccgtaccgctggaccctggagaccgccaagcgcctcggcgactctgcggtcgtcctcgacaacaagggcgagggccacaccgggtacgggtcctctcgctgcgcgagccagaagatcgacgcgttcctgctgtacggctccctgccggccaacggcagctcctgcggcccggaagcggaccgctgaccgccgcccctcagccggcccgctgctgcagccgggcgtgatctcgatggacccgttcgcgttcacccctgaggcacggcgaacgttcgccgccgccgtgccgatgggtttcactcgtggtgtgcgccggttcctgttgctgctgttcgtcgccctcggcgcggccggggcgctggtcctgtcgtgcgccgtctcgtcgtggtggtggatcgccgcgggtctgctgctgccgctcaccgcgctcggggtgtgggacctggtgcagacccgccactcgctgctgcggaactacccgctgctcggacatctgcggttcttgacggagccgccgcggcccgagccgcggcggtacttcgccgaagggcaccacgaagggcgtccgtacggccgcgccgtgcgcagcatcgtccacgagcgggccgagggcgtcgccaccgaggaaccgttcggcacggaacgggatgtgtacgccgccgggtacgagttcctgatgccgtccctgcgcccggtggaaccgcccgaggatcccccggtggtgcgcgtcggcggcccggactgcacccagccgtacgacatggcgctgctgaacgtctccgcgatgagcttcgggtcgctgtcggcgaacgcgatcctggcgctcaacaagggggcggcgctgggtggtttcgcgaccgacaccggagagggcggtctgtcggagtaccacctgcgcggcgggggcgatctcatctgggagatcggcacggggtacttcggctgccggacctccgacggcggcttcgacgagcgggagttcgcggacaaggtggcgctgccggaggtcaagtgcgtgtcgctgaagctctcgcagggggcgaagcccggcaccggggcggtgctgcccggcgtcaaggtgagcgcggagatcgcgcgggcgcgtgctgtgccggtgggcgagaccgtggtctcgccgccgtgtcaccggatgttctcgacgccgcgcgaactcgtgctcttcctcgcccgcataagggagttggcacacggcaagccgaccggcgtcaagctgtgcgtgggctcgcgccggcagttcctcgcggtgtgcaaggccatgctggcggaggggatcactcccgacttcgtcgtggtcgacggcgcggagggcggcaccggggccgcgccgccggagttcgccggccggctgggcacccccctcaccgagggcctggtcaccgtgcacaacgcgctggccggcaccgggctgcgggaccgcgtccggatcggggcgagcggcaaggtcgccaccggtgcggacatcgtcaagcggctgctccagggcgcggactacacgaacgcggcccgcgccatgatgttcgcggtcggctgcgtccaggcccggcgctgccacaccaacacctgtccggtcggggtcacgacccaggatccacgccgggtccgcgcactcgacgtggccgacaagtccgagcgcgtccaccgcttccagcgggccacggtgcggagcgcggcccggatcatggccgcgatgggcgtacgtgacccggccggcctcgcgcccgggatgctgctgcggcgcacggactcgacgacggtcctgtcgtacgccgagttgtacgagtggctgccgccgggcgtactgctcgcccagccacccccgtcgtgggaagcggactggacggcggcggacccggattcgttctgagcgggagggcggaacccgaacggcggaacccgggcggccgagccgccggacgccacaggccgaggccgggtgccaggagtcgaggccggatgccacgggccaaggccggacacgacaagtcaagaagtaaacaattaccccgaatgcccgataagcgaatcggtcctatcgtgctggtatggagcatgccctcagtccctcatccctcgccgagctgcgccgcccgcggccctatcccgccgtgtccgtgctgacgccgacgcatcgccgcgagcccgacaacgcgcaggacccggtgcggctgcgcaatatgctcgccgacgccaagaagcagctggaggccgatcccgcgatcacccgcgagcggcgcaccgatgtgtccgcgcagctcgatctggcgctcgcggaggtcgatctcgcgcacgccgaggacggtctggccatcttcgcggcccccggtgaacaccaggtgtggtcgctggcgcgttccgtgccggagcgcgtggtgctgtcggacaccttcctgacccgcaatctcgtggccgcgcaggccgccgagcggccgttctgggtgctgtcggtctccgccgaccgggtgacgctgtggaacggcggcgcgggccgtgtcgccaaggaacgcaccgggggctttcccatggcccggagcctggaggccccgaacgccgagcgcaaggagcgcgtcggcgacctgcccagcaccttccgcgatgagcgcacccggcacttcctgcgcgacgccgacatcgcgatgagtgccgtcctgcgcgcacaccctcgcccgctgtacgtcaccggcgagcaggcggcgctctcgctgctcgacgagatcggctcggtcaccaaggatgccgcccacgtcccgcacggcggcctcgcccacgcgggccccgacgcggtgtgggcggcggtccggccgctgatcgacgccgaggaccggaagaacgtcgacacggtgatcagggacctcgaaacggcccgtggccgcaaagatttcgcggcgggcgtcgacgaggtctggcagaacgccggggacggccgcatccggctgctggccgtcgaggagaactaccgcgtgacggtccgcgacaacggcggcgaccatctggtaccggccgcgagcgatgacctcgacgcccgggaggacatcgtggacgagatcgtcgaacagtgcctggagacgggtgccgaggtgcgcttcgtccccgacggctccctcggggaggcccggggcatcgccggggtgctgcgctactgacggcccgggaccgctgctccgccgccccgcccggcgtcctacgctacgccgacagaggtgacggacaaggaggttcgggacgtgagtcagcttctcggcgttgcggtactgggtgcggggcacatgggggccgaccatatacgtcgtctcgacagcgtggtgagcggggccagggtcgcggccgtggcagatccggcgaaggagcgggccgaggaggccgtggccggcctcgacggcgtcttggtgcacaccgaggtggcggccgctctcgacgcgccgggcgtcgaggcggtgctgatcgcctcacccggacccgcgcacgaggaggcgctgctcgcggccttcgcacgcgggctcccggtgctctgcgagaagccgatggtgccggactcggcgggcgcgctacggatcgtggaggcggaggcacggctcgggcggcggctcgcccaggtcgggttcatgcgccggtacgacgccgagtacatggggctcaagtcgctgctggacagcggaaggctgggccgcccgctgatgctgcactgcacgcaccgcaatgtgtcgtccccgcccggcttcacctccgccatgctgatcaacagctccgtgtcgcacgagatcgacgcggcgcgctggctgctgggccaggaactcaccgcggtcaccgtgctgcgtccgcggccgtccgcgcatgccccggaaggtctgctggatccgcagttcgtgctgttcgagaccgccggaggcgccctggtggacgtggagatcctcgtcaactccggcttcggctaccaggtgcgctgcgaggcggtctgcgaggccgggagcgtgcggatcggggacgcgcacacgatggtggtgaccagcgcgggcggcgcgtaccaggaagtggcccaggactacctcgtacggttcgcggacgcgtacgaccgcgaggtgcgggagtgggtggacgccacccgccggggccaggtcaccgggccgagcgcctgggacggctacgcggcctccgtcgtcgccgaggcgggggtgcgggcacaggacaccggcgaccggatgaccgtcgaactcgccccgcgtccggatctgtacggccagaacccgatcagccgctgacgctcaagccgtcgcacgcctgaccatcgaacacacgcgtgagcaacggggcggcacacctcggcgacccctcaagtcacgtacgtcacctacgacttgacccctacgaacccctgcgccactgatccggcattgatcccatgaacccaccacgggaggacgtaggcatatgccagaagcaccaccgtatcgtgtgttgccgaatcccttacagggcgtcgcaggctgtgcaagagtcgtaacggtccttccgccagccttggtcgtaccgtcccccctcggagcgcgtcatgccgtcccatctctctgcggatcgccccgccgcccagccgcccccgcgcggcacggtcgacgcgctcatctcgcagacgcggcgactgcgcggcgacgtggacgccgtacgacgtgacgcgcccgcggacggcacggacccgcaaggccgctggcagcgcgcactgtgcgatctggcggtacatcaactcaacgatctggacgcgcacttggcgcagttgcgggacggaccacagcccgcgccggccgccccctccaccgccggccccgccgagcgagccgtgcccaccgccccccggagcggctccctgctcagccgcgtcggctccgccgagtggaacctgctgacggacgaggcgacatggtccggcgagctgtatcagatcctcggccgtgatccggccgctcccccgctcaccctcgacgaactgccgtccttcgtgcacgacgaggaccggccgaggctgacggcgatggtcaccgactgcctgatcgacgcgaagccgatagacggggagttccgcatcgtgcgccccgacggcggcgtgcgcaccgtgcacatgatgggcgagcccgtcctcgacgcccacggcagcaccgcctcgatgtgggccgtgctgcgggacgtcagcgaactgcaccgcagccagcggacggtgagcgagacccatgactcgctgcaacaccaacggcacctcgcgcagaccgagcaccggctcgccgtcgagctacaggagtccgtactgccgccatggcgcgcctccctgcggctcccgcaccagggccccgaaacgctggacctggccgcccactatctcccctcgtcgtcgagcgcgctgatcggcggcaactggtacgacgcgctcgaactgcccgacacccagatgctgttgagcgtcggcgacctcaccgggcacggggtcgccgtgacctcgggcatggcgatgctgctcggcaccctgcgcggcctggccatggcgggtacccagccgggtcagctcatgcaatggctcaacggactgctcgacgcctccgtccagcccgccctgggcagcgccgtctgctgccgctatcaacccgagacgcgcgtactcacctgggcacaggcaggccaccccgccccgctgctgttccgcaacgggacggggcgcctgctggcagcaccggacggcgtgctgctcggagcgacctcgggtgccgcctacgggcaggccgaggagaccctccaagcgggcgacctgctgctcctgcacaccgacgggctggtcccgcggcgatgggcggacccccgctcgagcgaagccgagagtgggggaggaacggcggccgtccaaaggctgctcgacctggccccgcgcttcgacggggtccgcacggcccagcactgcgtacggacggtggtggaagagttcggcgagacggagcgcgaggacgacgcctgcgtgctcgtcgccagggtcgtctcctgacggacccggaaaccctgccggtcagaggcacatcgctacgcctcgaacccggcgaccacccctgatggaccgcgacggtggacggtgtggacggtgacggtggacgtcgacggcgggcccctcacgcccgtgcgctgccgcccctgaacttcgacgagttcttggggagggagagtttgatctcctcacgcagatcctggatcttcgggtagctggagtactccgcggtgagccggtacatctcgcgcagccggtcccaggtgcgctgggaggagttcgaccccatcgacgtcagggccagccgtgcgtaccggtccgcctgttccggatcgtcggcgatgaagcaggcggacgcgagggagatgtggtcgaagatcttcgaccggtcccggcccgactccctcaggtgcagcgcctccttggcgtggcgctgcgccatgatcgccgctcccggctcgtgctcggcgagggtgcgataggccagggcctgcatcccgtgcagatccgcctcgtcgaacatctgcatccagctcggcggcggcacgtcgccccggtcggagacgaacaggtcctccgcctcgccgagggtgcgccgcatggcctgccccttgcccatggccgcctgtgcccaggcctcgatggtgtagagcatggcctgggtgcggggcagtacctcgtcacccgagccggacttggcgagcttcatcaggtcgagtgcctcaccgggccggccgaggtgcaccatctgacgggcggcacgggagagcgcctccccggcacggggccggtcgcctccctcacgggccgcgtgggcggcgatgacgaagtacttctgggccgtgggctccaggccgacgtcgtgcgacatccaacccgcgagaacggccaggttggcggcgacgccccacaggcgccgctgaagatggtccgggtgccggtaggagagcatgcctcccacttcgttgagctgtcccaccacagccttgcgctgcagcccgccaccgcgggccgcgtcccaggcccggaacacctcgaccgaacgctccagttcctcgatctcctgcgacccgatgggggcagcctcgtagcggtcgaacccagcagggtcggcgtgcaggggatcgtcgagttcgggagcgtccgccgcgagggtcggatcggtgtgcaaccagtcgtgcatggcgctgctgagtgcggatcctgtggtgagcgcgacgcccgcgcccaccaagccgcgtcggttgagcatgaggtccattcccgtgaattcggtgaggaccgcagccgtacggtcgggcgcccacggcatcccgtcgggatgttccacactcccgtcgctctgccgtctccccatacgcccgtgccgggccagaccgaggtcctcgatggtcacgacacggccgagacgctcggtgaacagggccgccagcactcgcggcaccggatcgcgcggaatctctcccgtgtcgatccaccgccgcacccgagaggtgtcggtcgccagctgggggtggcccatggccgccgcctgccggttgaccagcctcgcgagttcgcccttggaccagccggccaggccgaacaggtccgagagacgagtgttgggttgtccgctcacgtcaagcccccaggttctcggctgagttgacagtaaccctctgtcagatgctgggcgactattcgccagggttcgccagggtgcgccagatggtgtgccagtggacctcaggtgtcaggtaggaacgcgccaccccgacccggtggccgccgggacactccccagggtgactcacggcaaccggggcgggcagcgcggcaacttgcaggcacacgaagggatctgtctcgcccatgtacacagcatcgtcctccgtgtccgcaccgccccggtcgctccacccccgccagccgggcagcagcggcccctacctcgaccccgcgcgacccgcggcgcccctgctcggtgccggtcggtcgcggcgcgttccggggctcggcacccaaccgctcagcgggagaatcgacttgtccggcccccagggcgcccagctgcgcacggcgatcgcgtcggtgcaccggatctgtccggagttcactccggtgcaggtactgcgccgcagcgggcgctccgtactcctcgtcggcacgacggggcgcagcacggccgtcgccaagtgtttacttgaccactcccccatctgggcggagcggatccggcacgaaatagctgcataccgctcgttcgtccggcaccgcccgcccgtgcgggtgccccggctgatcgcggcggacccggacaactgcacgctggtgatcgagcggatgccgggccgggtggccgcgctccagcggcatccggcggaggccccgccccgcgccgacatccgggcggccctgggcgcgctctgccgggtgaacgcgtggcggccgccggcggggacgttcgacgccccgctgaactacgcggagcggatctcccgcttccatgagctgggtcttctcacggaccgggacatgggggatctgcagaagctgatgcacggcatcgcccactcggcgggccggcagggcatgggccagttctgccacggtgacgctctcctgtcgaacatcctcctctcaccggccggtccagtgctggtggactgggagcacgcgggctggtatctgccggggtacgacctggcgacgctgtgggcggtcctcggtgacgccccggtggcgcggcgccagatcagtcagctcgcacagtccgcggggcccgcggcacgcgacgccttcctggtgaacctgatgctcgtactgacccgagagatccgtacctacgagacggccgtgcagcgttcgatgcacgacgtgaccccggcggcaccgggccaggcccacccggctgctgcgccgtccggcgaggaacagcggctgctgctgcggcggctgcacgacgactgtcagatggcccggcgggccgttcgagcggcagtcggcactcgctgacggggatgacggcccgcggtgccccttgggaaaaagcggcgcaccccggcagaccttcgtcgtgtccggggtcggacgcaatgtccgccggacgagttattggtccactccactgacgccccgcaggccgggtcaccaccgcctcgaaactcgctcgcgcctcggctgacatgggaaatcgccttcccctgtagatgattgacggatcgtcggtgagccggtaccactgacgcacgttcggcccccgcacgccccaccgcgctcgatctgcccaggaggctgcattgcgaggatccgccaccgacccccggtccaccgtcggtcacagacgcgcgcgcggagcggcgggtgccgtcgcctcggcggcgctgctgctgccgctgctcggcgcggctccgtccccgggcgccgccccggactcctccgccgagctccagcgggcgttcgccacggcgtccgccgaccaccaggtaccgcagagcgtgctgctcggtgtctcctacctccagtcccgctgggacacgcacgccggcgcgccgagcgtctcgggcggctacggcccgatgcatctcacggacgcccgcagcgcgatcgccggggccccgcaccacagcgcgggcacggaggacgcccgcggtgacgaggcgcgtacggccctgctgcccaccaccgaggtgccggagaactcccagctccccgcccgcctcaagacgttgccgaaggcagccgagctgaccgggatcccggccgagcggctgcgtacggacgccgccgccaacatcgaggggggtgccgccctgctcgccgccgcgcagaagaagctcggcgagcccctcagcggtgacgcggccgactggtacggggcggtggccgtgttctcgggcgcggacgacaccgccacggcggccgcgtacgcccgtgatgtgtacgacgtgatccgcgagggtgcgcggcgcaccacggacgccggtcagagcgtgacgctggccgccgagcccgggtcggctcccgacaccgcgcagctcgggcgcgccgggctgcgttccgtctccgccgatggcacggaatgccccaagtccctggcctgcgagtggattccggcaccgtacgaagagttcggcgacaacgactacggcaatcacgacctgggcgaccggccggcctcgcagagcatcaggtacctcgtcatccacgacacggaaggccgctgggacggtgtcatcaacctcgtccaggaccccacctatgtgtcgtggaactacacgctgcgctccacggacgggcacgtcgcccagcatgtgaaggcgaaggacgtggcctggcacgcgggcaactggtacatcaacgccaagtcgatcggtctggagcacgagggcttcctcgcctcgccggacgcctggtacacggaggcgatgtaccggtcgtcggcgcggctggtgaagtacctggccaggaagtacggcattccgctggaccggcagcacgtcctcggtcacgacaacgtgccgggcccgaccaccgcgacgattccgggcatgcacacggaccctggcccgtactgggactggcggcactacttccggctgctcggcaggcccttccacgccacggcgggccggggcggcgggctggtgacggtcctgccggacttcaccgccaaccagccggtctacaccggctgcgtcaccgcgggcctgccctgcgcgtcccacggctccagcgaggtacgtctgtacagcggccccgacgagaccgcgcccctgatcaaggacatcggtctgcggcccaagggcgacgattcgacgatcgatgtgaacgacgtgggttcgcgggtctccaccgggcagcggtacgcggtcgccgaccgtgcgggggactggacggcgatctggtacctgggccagaaggcctggttcaagaacccgaagaagcagccgacggcggtgaacgcgtcggggctcgtggtcacgccaagggcgggactcacggacatccccgtgtacggccgcgcctacccggagaaggaggcctatccggccggtgtgcccgcgcagtcggtctcaccgctgccgtacaaactgctcgagggccagaagtacgcgatcggggacgaggtgccgggcgagtactactacgcggtcaccttcgacacgccctcgcacaaggtcgtgaccggcacggaccgctactacgagatccagttcggccaccgggtggcgttcgtgcgggcggccgatgtgcaggtcgtttcgtcgaggtcgtaggagggactcgggtgccggggccgccctgcgggccccggcacccgcgcgtgtgctgagcctgctcagccctgctggaagagctccgcgggcaggggcttcagcagtgcgtacaggtcgtccgtgatcgggcggtcccaggcggcgatggtcaccaggaccttgtcgctgcggtcgaactgcacacaggagatccggccctcggagagcttgaggcggcggacgatcaggaggttgtccccctgcatcaccggcatgtcctcggtcccgacgacggtcacctcctcctcgttctccagcgcgatcagcagctgggccacctcgaaggggacctccgactcggcgacgtcgcgggccggggagccctccggcagattgccgatgatcatcgcggggccgcggccgccgaacaggtcgtagcgcaggaagacgccctggcagctgccgtcgggggcgggcagcaggcccgcgccgagattgcccggccagtcgcccgggtccatggccagtacgtcgaagtcaggaccggcgggagtggcgctgcggcggcggaggaaggacatgtcgcaatggtacgtgcccggcggcgaaccgggctctgggggcggccgccgccggaggccgtggcgggccccggtcccctcgcaggtcgggcccctcaccggcggcccggcggcgccctgcgggagatgaccttgcggcggctgatccgcccgccgtgatcgccgagcacggcggatttctcgtccgtcgcgccgccggtggtgccgtccgcgtcgctgccgatgccctggacagagcacgcacctgccatcggcccgacgcggtgggcacgacgttcgtgaggtggtgggcgaccgggtcgccgggccgagcgcgcgcgacgcgtcccggccggcggtgatgcgctccagggccggctgcccgaagccgcagggccggctgcccgagccggtgatgccgcagaccgcatcgcatcgcatcggtggtgaacagcgcgccgagccggtccggattcccggcgtcggacaagttcccatgcggggcgaacagttcggcgatcgccgtgggtcgtcgaagccgggcgccaggagaatcctgctgtgatcggcaggatcctgcccccggccgggggccgagcgggggttcggccgcccccgggcggtgagcccgccgagatcgtccgcgggtctctcatggtcgtcgtgccggatggtcggggcggggtcgagggcgacgcgcgcgggccggcggaccgacgcgcctgacgtcggcccgcccggcctccgctcacgtcaggtcgaactccccttcgcgggcccccgagacgaacgcgccccattccgcgggtgtgaagatcagagaggggctctcggggcggccgctgttgcgcatggcgatgaacccctcgacaaaggcgatctggacgtctccccgtcctcggctgctggattgccactcggccttgctgaggtccagttccggcttgtcccagcccgcgagtggatgctccttgatggtgctctcggccacgtccgtactcctcccggttcgtcgtccgccgccagcctagcgatcggtcacggcggcggacaggccacgtgagggggagggcctcacaagaccgggggctccgccccgaccagccacatcgagaagaactgcgacccgccgccgtacgcgtgcccgagcaccctgcgagccccttccacctggtgttctccggcctggccgcgcacctgaagcgctgcttccgcgaagcggatcatgccggaggcgccgatcggattggtggagaggaccccgcccgacatgttgacgggcaggtccccgtcgagttccgtcaccccggactcggtgagcttccagccctcgccctcgtcggcgaagccgaggttctccagccacatgggctcgtaccaggagaacggcacgtacatctccacggcgtcgatctcccggcgcgggtccgtgatccccgcctgccggtagacgtcggccgcgcagtccttgccggcctgcggtgagaccgcgtccttgccggcgaagagggtcggctcgctgcgcatcgcgccgccgtgcagccacgcgggcggccgcggcgaacgggccgcgcccgcacggtcggtgaggatcatcgcgcaggcgccgtcggaggacgggcaggtctccgagtagcggatcgggtcccacagcatcggggacgcctggaccttctccagggtgatgtcgtgttcatggaggtgcgcgtacggattcttcagtgcgttgcggcggtccttgtacgcgaccagggagcccacggtgtcgggggcgccgctgcgccgcatgtacgcgcgtacgtgcggtgcgaagaagccgcccgccccggcgagcaggggctgctggaaggggatcggcagggacaggccccacatggcgttggactcggactgcttctcgtaggccagggtcaggacggtgccgtggacgcggcccgcgatcaggttcgtggcgacgagggcggtggagccgccgaccgagccggccgtgtgcacccgcagcatgggcttgcccaccgcgccgagcgcgtcggcgaggtacagctcgggcatcatgacgccctcgaagaagtcgggcgccttgccgatgaccacggcgtcgatgtcggcccatgtcaactcggcgtccaaaagggcccgttgggccgcctctcggacaaggcccgcgatcgagacgtcccgccgggcggccacgtgcctggtctggccgatgcccacgacggccacgggctccttgctcatcgcgggtctccttcgagtagggcgaccaggttctgttgcaggcagggacccgaggtcgcgtgggcgagcgcgcggtcggactcgccgcggtggatgcgggcggcggcctcgccgatgcggatcagtccggccgccatgatcgggttggcggccagtgcgcccccggacgggttgacggtcacgcggtcgtcgagccgcagcgccctgcgcaggaccacctcctgggaggtgaagggcgcgtacagctcggcggtgtcgacggggcgttcgaagacgcccgccttctcggcggccaggcgggtggagggcgagtcggtcaggtcacggacaccgagggcgtgtgcctcgatacggtggtcgatgccccggatccaggcgggccgcgcgcacagccggcgcgcccgatcccccgccgcgaggacgacggcggcggctccgtcgccgacgggcgggcagtcgccggtacgcaggggacgtacgacatagtccccctgcggcaccgaaccgctcagctgcgcatgggagttggtggcggccgacgcacggctgcgggccgcgacaccggccagtgcgggctcgtcggcgtgccccgcgtcgatgagcgcctgcgcctgaagggcggccagggccacggagtccggccacagcggcgccacgtagtacgggtcgagctgccgggtcaggacgtcgcgtacagagccgggtgacgacttcccgtacgcgtacacgagcgcggtgtcggcgtcgccggtcagcagcttcgtccacgcctcgtacagcgcccacgccccgtccatctccacatgtgactcggagatcggcggccaggcgcccaccccgtcgagcgccatggtgaaggagaaggcgcggcccgcgaggtagtccgtggagcccgagcaggtgaagccgatgtcgccggtcttcaggccggcctggccgaggacgtcgtgcaggaccgggatgagcatctccacctcggagagctcgtcgctggtgcgccggtggtcggtctgcccgaaggcgactacggcgatctcgcgcgtcacagcagctccttgtacgtctcgtagtccgcgtcgggttcgccggtgggccggtagtggtcggggtgacgcccgccgtccgtccataccggctcgacgcgcagacccatgcgcacctggtcgtaggggatgccgccgatgcggccgtgcagcgcgaggtccgcgccgtccagtgcgatgtgcgcgtagacgtacggcacttcgatgtcgaggttcttcgctttgatgttgacgatgcagtacgtggtgaccgtgccgcgcgggcccacttcgaccgcttcggatgtggcgacaccgcaggtggggcaggcccccctgggcgggacgtagaccttgcggcaggaggggcagcgttcaccgacggtccgctgttcggcgagggcgtcgaggtgggcggactgcgcgcggccgggtgagtagacgtagtcgagacgggccggggcgacgatgccggtcaccgggtcggcgaaccggccgtcgtggccggtgggttcggccgccgcgtcgtcgccggagtcgtacggttcgaagcaggcgatgtccgtgatggctccggagcgttgcgcggcccagcggacgcggacgcgcaggccgctgtgtacggcgtcggggccggcggcgtcgagggcgtggaggagggccgtgtcggcgccgtcgagcctgaccaggacccaggcgaagggggtgtcgaggggctggccgcggcgcggggcgtggttccaggcccaggtggtgacggtgccggtgggggcgacttcgacgaggtcgtggatctcctcggcggtgacggggtcgtactcgacgggtgggacgagtgtgcgcccgtcgccggtcttcacgccgaggagcacgcgctcgcgcagaccggtgaggaaggcgctctggacggggccgagtgagcgggtgaaggggaactccacgaccaggggggctttgaggacttcgggcacggggactcctcgtgggggtcggctcaggtgcgcctgtacacgggcgggcgcttctcggcgaaggcgcgggcgccttccttggcgtcggcggtgtcgaagaccggccagccgcgcttcagctcggccgcgagtccgtcggtctcggtcatctccgcggtctcgtacacggaggccttgacggcctcgacggcgagcggtccgcaggcgttgatccgcccggcgatctccagggccgcggcgagggcggtcccgtcggggacgacatggccgacgagcccgatgccggccgcctcccgcgccgggtacgggcgtccggtcagcagcatctccagggcatgggtccgcgggatctggcgctggaggcggaccgtggagcctccgatcgggaacagccccctcctgacctcgaacagcccgaaggtcgcggactcgccggcgacccggatgtcggtgccctggaggatctcggtgccgcccgcgacacaggggccctcgacggcggcgatcacgggtttgcggggacggtggtggcgcagcatcgccttccagtgcagatcggggtcggcctggagccggtcccggtactgctgcccttccatcccctggccggccagggccttgaggtccatcccggcgcagaaggcaccgcccgcgccggtgagcacgaccgagcggaccgcgtcgtcctcgtcggcctcgacccagccgtcgtacaggccgaccagcatcggcagcgagagcgcgttcctggcctcgggcctgttgagcgtgagcaccagtgtggcgccctcgcgccgcacggtgaggtgttccgtcccacccattgccgtcctcccgtcagacaggctctctggaacgagaacaggttgcagtaggtgcgggaccagtacaagagttttctgacagacagtcagatttcttgtcccggggcccttcccagttgcgtcggcctttgctctgatgaccgtcgagccgatggatgccaggcgtgcccggggtcaggaggagcggtggagtacaaccttgccgacctgttcgagtcggtcgtcgacgtggtccccgaccgcgaggccctcgtgtacctcgaccaccccggcacgggcgcggagcgccgtctcggctacgcggagctggacgcggcggccaaccgcgtcgcgcaccatctgatcgacagcgggattcgccccggcgagcacctcgggctccacctctacaacggcgtcgagtacctgcagacggtcctcggctgcctgaaggcccggatcgtcccggtcaacgtcaactaccgctatgtagaggaggagttggtctacctctaccgggacgcggatctggtggcgctggtcttcgacgcggagttcaccgagcgggtggcggcggcgctgccgcagacggagaagctgcggcacctggtgcgggtggggaccccgacatccggcgccggtccgctgcccgtggtggagttcgccgacgccgaggcggccgggtctccagggcgcgggttcccggcccgctcggcggacgaccagttcatcatctacaccggcgggacgaccgggatgcccaagggggtgatgtggcggcaggaggatctgttcttctcgggtctgggcgggggcgctccgacgggcgagccggtgaagacgcctgaggaactggccgagcgggtggcggcgggcggggagggcatcaccttcttccccgctcccccgctgatgcacggcacctcgacgctgacggccttcatcggcttcaacttcggccagcgggtcgtcatccaccgcaagttcgtgccggaggaagtcctgcggacgatagagaaggagcgggtcaccagcatgtcgctggtcggcgacgccatgctgcggccgctgatcgacgcgctgagcgggcccatgaaggggaccgactgctcctccatgttcagtgtgtcgtcgtccggggcgatcatgtcggagaccgtgcgcgcccagttccaggcgctcgtgccgaacgtgatgctgctgaacaacttcggctcgtcggaatccggcttcaacggcacggcgacccctgactcgggcccggaccgcggcttccggatccgggtcaactcccgtacccaggtggtggatccggccacgcacgagcccgtcgcggtgggcgagcccggccgcatcgcacagcgcggccatgtgcccctcggctactacaacgacccgaagaagaccgccgagacgttcttccgcaagggtgacgagcggtgggtgctgctcggcgacatggcgaccgtcgacgaggcgggcgtcgtcaccgtcctcggccgtggctcccagtgcatcaacacgggtggggagaaggtgtatccggaggaggtcgagcaggcgctcaagtcgcatccggacgtgtacgacgtcctggtggccggggtgccggacaccacgtggggcagtcatgtcgcggcggtggtgcagctgcgcgagggcgcgggacggccgtccctggaggagatccagacccactgccgcacccgtctggcgggctacaagatcccccggcaactggtcatcactagcaccatccaacgctcgccgagcggcaaggcggactaccgctgggcacggtcggtggcggcggaggccgaccgctgacggcaaaggcccggcggcccgccccctccccgctcgcgggtcggcgttgttcgcccacggctggaccggttgccccgtgccgacgcggcggagagcgtacgggcatggccttctccgtggcacatctcagcgatccgcatctgacgaccgggctgctcgccgtggaccgagtcgccgccttctcccgggccctgcgctgcgtcctggccctcgacccgcgacccgcctgcgtggtcgtcaccggtgatctggtcgaccggggcgaggccgaggagtacgaggtgctgcgcgaggtcatcgcgcgcttcccgctcccggtgcacctcgtgccgggcaaccacgacgatcccggcaccctgctggaagccttcggcggcggccctcatacgggcggcgcccgtgcgttcccgtacgccgtggagtatccgaacgccaccgtggtggtcctgagctccacggtccccggggctccctcgggccggctcggcgacgagcagctcgaccggctggaggagctcctgtccaggcgcccggaggtgcccgccttcgtgtgtctgcaccatccgccggtcgacatcggcatcccgtacctggacggcatgaacctggcggacgccgacgcgttcggcgaagtgatcggacggcatccgcaggtcgtacgcgtactggcgggccatgtgcaccgggcggtcaccggggagttcgcgggcagcacgatggtcaccgcgcccagcacctacttgcagagcaatctgaacctgcgcgtcggcggaccggtgggatacgtcgacgaaccgacggcgttcctgctgcaccacctcaccggcacggggtgcgtgacacacaccgctcaggtcagccacgcgggcgggctcatcggggggtactgaccgggtgcgggccggtgtcggtacgcgtcggggctcggggaccgcatcacccgagcccacggccgcgacctcgacgagccgtgtgggagggcggcattcagccgcggtacccggcgctctccgcgcgctgcccgggcatccctcccggcaggccacccgcgcccagccgctcgaaccgctcctggacattggccgcgaaggcccgctgctcggatcccgcgaagtcctgcccggtggtgttcatggccaccgtgagcacaccgctgatcggggcggccggggacgtgcgcaccggtgtgcacaggaagttgaagtcctggagggtgtgggagtcgtacgtctggatcgacgcccgggccagcgtggccgcctgtcccgtgtggaaggcgtcgtccatcgcgccgaagacgcctatcgcctcgaggccgggcaggacgtgccgcccggggctgaactgcgggaccaggccgaaggccgagccctgcttgccattggcgtagcgcagcagatggtcggggccctcggtgagcatgatcgggaacggcgcaccgtcgaagacggcgaacagctcctgctgctgggcgagcaggctgtcacgcagcttgaagtcggacagcagggtctcggtgagctcctgcatgccctcgcgaagaccgcggtcccaggtgcggggcttcatgtcggcgacgcacacggtgccgaggatcatgcctgtgttgtcccgcagcggggtgccgaggtaggaacgcacgcccaggtcgttcaccagcgggttgcccttgaagcgcgggtagtcgaagacgtcgtccagagccagttgggaaccctgggccaccacatgggggcagaatccgtagtcgccgggcgcttcccgggagaggttgctcagatcgaaggcgatgcctccgctctccgggctcaccttgtcgtcgggcgaaccggacggcacgtacatgccgcggaacatctgccgttcgtcgttgatgaagttgaccatggccaacggagactgggtgaagctggccgcgagtcgcgcgatgcggtcgaacgtggcctccgcctcgacggtattgaggccgagaacctgcagtcgcagcctgcgctgctcgctcgcgagccgggccggatcggaagatgagagggggtccatgggatcagatgaaatcagaatcccggcttccgtggatcacccctccccgtattttccgcatcaggtgcctcacactcaacgcacttgaccccgccgggacttgactcgaaaggtccgctgatgctcgcgtgaccgtgccgccccaccggcccctcgcagttacccaacctcaaagactgtccacatacttcaaggtttcaaccttcgacgatcacttcccgccattccttgagcggccatcgagcggaaacgattttgcatacgacaatcgtgcggtgggctggttttcgacgctgacgcgttcattccgtcacgccatccaatggtcgaacctgagttcggacacgcgatggcggggcggaagtgatacgtccctctgccggggcccgtgcgtaccgagttgtggcgatacgtctgcgagagagggcacagcggagtgggtcaggtgcggttcgagccgcgggcgtcccgccgggggcgggtgcggcaggaccttttcggtcagagcgccatacgcgatttcacgccacgatccacgccgccgccgacggcccgagactccgtgcgaggcgaccactcgccggcccggtcagaggtgatggccgctcggggcaccgagcccgactgagcgaggagcccggtacgacgacgtccggggctcgaaccacttcgtaacccatcctcatcccgcccggaaacgggggtcctggcggcatcgcggcgcgagagacggcaggggagccgtccacaggcgccgctcccaggaatgccgtggggccacatgtccccgcccgggagccatgcggcaaggtcaactgcgccatcgcgtacggacagtggcgaaggatcgaaagggattgctcatgaacaggtcggacgtggacgcacggtcggtggctgtgatcggcatggcctgccggctccccggcgcgtcggggaccgacgaactgtgggccctgctgcgggacggcgtggacgccaccagcgagacccctcctgaacgttacgacgtggacgccctgcactccgtcgcccccggaccgggaggcatcgccagccgcagagcgggctatgtcggccaagtcgcggatttcgatgccgagttcttcgggatgtccgccaacgaggcggtggaactcgacccgcagcagcggctgttgctgatgaccgcctgggaggccctggaggacgcgggccggcggcccgacctgctggcgggcacccggaccggcgtgttcgtcggcaatgcccgcgcggactacctggaactcgccctgcggcagggcccggaggcggccacggcctcccagctgaacaacttccggtcgctgttgccggcccgcctgtcgcacttcttcgacttccgcggacccagcatcgtcgtggacacggcctgctcctcctcgctggtggccgtgcaccaggccgtacagagcctgcgcgccggagagagtcccctggcgctggccgccggggtgaacatcacgctccgcccggacgagggcctcgtgatgacgcaggccgacgccatggctgccgacggccgaagcaagttcggcgacgcgcacgccgacgggcacgcccccagtgacgcggtggccgtcgtcgtactgaagcgcctggcggacgccctggccgacggcgaccgcatacgcgccgtcatccagggcagcgccgtcggcaacgacggccgtaccagcgacaccgtcctcaatccgtcgctgaccggccagctcgaggtgctgcgatgggcgtacgaggacgcgggggtgaaccccgccgatgtcgactacgtcgaggcgcacggctccggatcgcccgccctcgacccgctggaactgggcgccctgggcagggtgctgggcgagggccggcccgccgaccggccgctgctcgtcggctcggtcaagacgaacatcgggcacgcggaggcagcaggcggactggccggactgatcaagacggtgctctgcctggagcacggccagatcccggccagcctccacctcgacaccccgaacccccaggtcgcctgggacgaactgccgctggtggtaccgggcaaactgctcgacctccccgagctggaccggccggccgtcgccggggtctgcgggcagggctcctcggccctcaacgcccatgtggtgatccggcaggccgaccccgcctggtccgcgtccgcgccgccgggccgggccaagccgtacgtcctcgcgctctccgcgcgcagcgccgcggccctggaggcgctggcccggtcgtacgccgaccatctgggcccggacggcgcgggcaccgcgtacgcgctgcgcgacatctgcttcagcgcggccacccggcgtcagcaccatgagcaccggctggccgtcatcggttcgacgcacgcggagatcgcggcggcgctcaccggatcgccggggctgggcggcaggccgctgtcggccgtcgccgagcgctaccgcaggggcgaggacgtggactgggggaaggtgttcgggcgctccggccgcttcgtgccgctgccccactacccctggcagaccaagcgctactggcccggcgaggagcacgcgcaggacggcggcgatctggcgtcctgggtcctgcgcgagcacgcccgcaccggcttcgacgacggctccacgctcaccgagatcgggatcgactccctggcgaaactgcggatcgtcgtcgaactgaccaagcggtccagccaggacgtcgacccggaggagttcggccggctgcgcaccgtcggcgaactccgccggtggacgcggtccctggaggcagcggcccgatgagcgatccgcagaacctgtacgcctggttcgcccgctcggcggccgcgtacggcgacgagtgcaccgcgctggagatcggcgacgaccggctctcctacggtgcgctgcgtgacctggcggagcggctcgccggccgtctggtcgcggcggccggcggcaccccgccgcgccgggtcggcctgctggcgagccgttcggtgaccgcgtacgccggttatctcgccgtgctgcgggccggtgcgaccgtcgtgccgctcaaccccgagcacccgtccgcgcgcacccgcgacatcgtcgaagcggcggggctcgagctggtgctggccgacgccccggcggccggcgcggacctcggcgtgcccgtcctcgtggcgggccccgaggaactggcggccctcgcggccctcgtggacgagccggtgcccgaactgccggacgcgcggaccggtcctgacgacatcgcgtacatcatcttcacgtccggttcgaccggcgcgcccaagggcgtaccgatcctgcaccgcaacatctgcgcctatctcggtcaggttgccccgcgctacgacatcgagcccggcagccgcctctcccagtccttcgagctgaccttcgacggctccgtgcacgacctgttcgtcgcctgggcgggcgggggaacgctcgtggtgccgatgcgcagccagctgctgtcaccggtgaagacgatcaacagcctgcggctgacgcactggttctccgtgccgtcgctgatctccttcgcctcgcgcctcggcacgctcgagccgggcagcctgccgacactgcggtggagcatcttcggcggcgagccgctgaccctggcggcggcccgggagtggcgggcggccgcgccggacagccgcctcgaagtcctctacgggccgacggaactcaccatctcgtgcaccgcgtaccggttccccgacgatcttgcggactggccgaagacgcccaacggcacggctccgatcggcacgtgctacccgttcctggatctgctgctgctcgacgcggacgaccggccgagcgacagcggcgaactgtacgtacgcggcccgctgaggttccccggctatctggacccggcgaacaacgcgggacgcttcctgacgtccgctcagcaccccgccaccgaggaaccactgaccgaccgccactggtaccgcaccggagaccgcgtcgccatgcgggacgggcacctggtccatctcggacggaccgaccaccaggtcaagatccgcggccaccggatcgaactcggcgagatcgaggcgatgctgcggcagcagcccggcgtccgggacgcgatcgtcctcgcggtgccggcctccgacggcgagccggagctggaggccgcggtcagcggcaccggctgcgtccccgaccggctctactcggcactgggcgaccggctgccgccgtacatgctgccccgccggatcgccgtcctcgaccagctgccgctcaaccccaacgggaagatcgaccgacgggccctgctcgccgaactgggacgctcccgctgacccacggcgtcctcgccgaaccgccccgacaccccactccccgacgtctgttgtgaggcacccacatgttcgacgccatcgtggtaggcgcgcgctgcgccggagcgtccaccgccatgctgctcgcccgctcggggtaccgggtactcctgctggaccggtcggcggccggctccgacaccctctccacccatctcgtccaccagccgggcgtcgcggctctcgcccgttgggggctcctggagaacgtacgggcctcggggtgcccgccgctggaccgggcggtctacgaggtggccgacatccacctcgaaggctgcgccaggggtgtggaggggcagcgtgcctcgtacgctccccggcgccatgtcctggacgccatcctggtcgacgcggccgtcgcggcgggcgtcgagttccgcgaccgctgccaggtcaccggcctgctgcgggacggcaccgggcgcgtcgtcggcgtggagggcagacacggcggccgctccttcaccgagcgggcccggctggtgatcggcgcggacggcatgcgctccaccgtcgcccggctggtcgaggcgccgtacaccgtgacggatccacggctgacctgcgcgtactacacgtactggccggacgtgccggccaccctggaactgtacgagcgcaccgggagctgggtggccgccgtggccaccaacgacgcggcgaccctcgttctcgcctacttcccgcaggtccgcttcgaggaggtccgcaccgacgcgcgcggcgcctatctggagcagatacgcaccaccgcgccggccctgcacgagcggctgcggggcaaggagcccgccgagcggctgcgcggtacgggtgaccagcagaacttcttccggcaggcgacgggacccggctgggtgcttgtcggcgactccggacaccacaaggactccatcaccgcgcgcgggatcagcgacgcgttcctccaggtcgacaccctcgtccggcacgtggacggtccgctcggcggcgacccggtccgactcgacgcggcgctggagaagttcgccgaggaacgcgacagcgcgctcaccccgggttacgaatccacgctggcggtcgcccggctggcgccgcacgagcagcgcctctccctgctgcgggccgtgcagacggatccggaactcaccgcgatctacttcgacatggtcgccgggatcggctccgcgggtgccctctacacacccaagctgcttgccctgctctgacccgtttcggggcgaacggcgacccggacacccgcggtgacctgccaggacggtaagtcgccaactcctgtcgaatggctggcagttgccctgggccggtgctgacgctgcgccatgatcctgatacggttccaccgatcgccgactccgatgacagagagtcaagtcgcctcgccggtggcaagatcggcactttttgcaccttccctgaccgccccagtgtttcgctgccgtacgaggaatcagatgccaggcacccgcgaccggcggacgcgtcatcggtccgccccgcgcagatctctccggttctcgttcgtcctgcccttcgtcgtgcccgcggtctgtctcaccggactctggggatacacggcggccggactcgtcgacgagcaactccaactgcactccgacgcggatcgggcctcctccgtcgcccggccggcccaggacgtgctgtcccggctgcagaccgagcgccggctgaccgcggtctggcaggcgagccgcacgaagaccgcccgtacggagctggacggcgcccgcgacgagaccgacgccgccgtcgccgcgttccggcgcagttcctcctccgcgctggacacctcctcgctccagcggcggaccaggctgttcgacgaggctctcgacaccctttccggccgccgcgaggcgatcgacggccgcaccctcagtacgggcgacacgttcgagttgtacaccgacaccgtgtcccgcggtatcggcgtcctcaccgcggccgtacacagcgacgacggccggctcgcgcggggcggcaacgcgacggtgtccctggcccacatcacggagatgctctcgcgcgaggacgcgctcatctccggcgcgctgccgtcccgtcggatgaccgccacgacccgcgcccagttcggccagtatctggcgatccagcgcgagttccgcgcgggcctggacatccacgacctccctgccggtgcggccgccacctacacgcagctcacggacagcgccaagtggaccaccctgggcacggtcgagaagtccgtgaccaccggccggggcacggggctgcccggtcaggcctcgtcctggccgacggccaccgagcccgtcgtcggcggcctgcagtcgctgggcgcggactccgcggacggtctgtccgacctggccgccgaccacgccgacgacctgctgctcggcatgctcctgggcacggccgcgacgctggccgccctggccggcggtgcggtactggccctgcgcgcccggcgctcgacgctcggccgggtctccgagctccaggcgcacgtcgagcagctgtccggcagctggctgccccagcttctggcccgaatacagaacggcgagcgggtcgagccggccacgctcgccccgcacggagagcaggcgaccgacgagctggagcggctggccgcggccatcgaccagctgggccgggtggccggggacaccgccgtacggcagagcctgggccgcgagggcacggagaaggtcttcgcccagctcattcgccgtacgcagatcctgatccaccggctgatctcgctccttgacgacctcgagcgcaagcacgaggactcggacctgctcaaggacatcttcaaggtcgaccatctcgcgacccgggtgcggcggcacgcggagaacctggtgattctcagcggctccccgcccagccgccggctgaccgctcccgtctcgatcaccgacgtgatgcgcggcgcggtcgcggagacggagcagtacaccagggtcaaggtgaagaacctccccgcggaccggcgcctcgccctggccggccgggccgtcgcggacgtcacccatctgctcgccgaactgatcgagaacggcacgagcttctcgccaccggacacccaggtgttcgtcagcgccacgaaggtcgccaagggcctggccgtgcacgtcgaggaccacggcctcggcatgccgcaggacctgcgcgaccacgcgaacgacctgctcgcccacccgccgcggctggacatgacggccctgggcgaggacccgcggctcgggcacttcgtggtggcccggctggccgaacggcacaagatcaaggtggagctgcgcgagtccgtctacggcggcaccctcgtgatcgtgctcctgccggccgccctgctcgaagaggtggcctcgccggttctcgaccagctcaagtcggccgccgtcgctgccaacagggcagtcgcggccgaggcctcccgggcggtcgcggggacggacgacttcgctgtcgtgggcgccgagggcatgccgctcgtgggctcggccatcggatcggccggccacagcctcgacgcgggcgtcacgatcggcggcgtcgacgcgctcacgcacacgcgccttccggaccacagcggcttccccgagtacggaggtgcgggcctcttgccggccgcctcggaccaccccgccccggctcccggacccaacgcctcctgggcaccgccccgggagcaccccgcgccccagggccaccgcaccgagccgggcggcctcggaccacaggccgggcagcccgcacaccccggagcacatgccggacaccacggatcgcgggccggattcaccgagccgcagagcggtttcaccgagccgcggtccgggccaccgtcccggcacgaacccggtgccggaagcgggggtcccgcccccgcccgggaggaggcgcccgcacgcagtgcggcgcgcccgctgaccaccccgcaggtcctgccgcaacggaccaggggagccagcctggcgcagcaactgcgcagggaggcggagcaggcacagggccgacccgacggtgagggagacaagggcgtcatctccccggacgcgtcggcccgcgcgatgatcgcaattcagcaggggctgaagcgggcccggatgtccgagaccgacgagccgaccggtgcggacggccggcagcagacggatccgagggaccccggtgcccatcaactgtgaggaaacgttacgtaatgactgagcaggtacaatccggtccccggctggactggctcctcgacggactggtggaccggataccggagatccgctgtgccatcgtgctgtccggggacggccttctcatcggcaagtcgaagaacctgcgccgcgacgacgccgagcacctgtccgcggtcggttcgggcatgcacagcctcgcccggggcgccgcgcgccacttccacggcggggaggtgcagcagacggtcatccagatggaccgggcgttcctcttcgtcaccgccgcgggccggggtgcgcggctggccgccatcgcctcggagcaggtggacgtggggatgatggccttcgagatgggcacgctcgtcaagcaggtgggccagtacctgagtgccgcaccgcgcgtggagaccccctccgccggacacattcaggatgcctgaaccccgatggctcgacgatgcggaggccgggcgtcacttacggccgtacgccatcacgggcgggcgcacccgccacagtcagcacaccttcacattgatcacgctggttgtcgcgcggtccgcgcatgagttcgatcacgaccatctggagccggagtcggtccagatcctcgaactctgccgggatcgcgcggtggcggtcgccgagatcgccgcgcacctggacctgccggtgagcgtggtgaagatcctctgcggagatctgctcaacgcctccctcgtcatcgtccaggcgccgcccgggcaggaggaccaaccgagcgtggaactcatcgaaagggtgatggatggtatccgtcagctctgagcccgtcatgccgacggcgctcaagattctgatcgcgggcggattcggcgtgggcaagacgaccatggtgggctcggtcagcgaggtgcccccgctggagaccgaggagcggatgaccgcggtgagcctcggcgtcgacgatctgtccggagtcgagggcaagaagtcgacgacggtcgccatggacttcggccggatcaccatcgcgccggagctggtgctgtacctgttcggtacgcccggccaggaccgcttctggttcatgtgggacgacctggcgaccggtgccctcgcggccatcgtcctcgcggacacccgtcggctggacgcctcgttcgcgtcgatcgacttcttcgaggcgcgtgacatcccgttcgccgtgggggtcaactgcttcgacggccggcgggactgctcggccgagcaggtgcggacggcgctggatctggatccgtcgacgccggtgctgctgtgcgacgtacgcgaccgtggttccagcaagtcggtgctgctcgccgtgttggaggcggcgcgtgcgcaggcggccgcgcgtctcgctccgctgggcggcggtcaatgagccggttccgctcccggctcaccgggcgaggaacgcctcgacccgggcggtgaaccacccggggtcgtccagccacgggtagtggccgccgcccggctgcaccgcgaactcggcggccgggaagacgtcggcgacccgccgggcgagctcggggcgggggccgccgtcgagttcgcccgcgtacacgaggacgggcgcggtgagtccggcgagcgcggcccgggtagcgggcgggtcgtaggcacccgccgagccgtaccggtcccccgcctcgtcgttggtctgctcctcgccaccggcggcgtgggcgcgggcggcgtcgtcccaacgcccgtagaagaagggctcgaagacagggtcccagtcgccgctctccgccagccacgcctcgaaggccgggaaggccgcctcgaaccagggctctcccttcctcagccgggccgccgccagccggtcctcgccccgcacgcccatcccgacggcccacggggtggcggtgatcagcgccagccgtgcgatccgctccgggtaccgggccgcgtagagcatggcgaggttgccgcccgccgagtgcgccagcacatccatgcgctcgaggcccagatggacccgcagcgcctcgacgtcgtcgacgagacggtcacaccggtacgtcgccgggtccgccggctccgcggagtccccggttccgcgcaggtcgagcagcacgagccggcgccgggcaccgagtccgcccaggtccccgagataggcggaggcccgcatcgccccgcccggcagcacgacgagcggttctccctccccccgcgtgtgataggcgagttcggtcccgtcgggggcgctgaagttcggcatgcgttcgatcctcacggctggggccgtctcacggcaacagggttctcgggtcgggaccggcgggccgtgagaaagtcggggccgacctcttgcctgggcgtgagccggctggattactgatctccagcagggctaccgaatgatcggtcgcccgtattgacacggttggtgagggagagggttcccatggcggatgcgcgggacctgctggacgagggagaacggctcgacccggacgggctgcggacgctgcaactggagcggctgcgcgcctcgctgcggcatgcgtacgcgcacgtgcccttctaccgggagtccttcgacaaggcgggcgtacgtcccgacgactgccgcacgctcgacgatctcgcccgcttcccgttcaccgtgaaggcggaccttcgggagaactatccgtacgggatgttcgccgtgccccaggaccggatccggcgcatccacgcgtccagtggcacgaccggccgccccacggtcgtcggctacacggagaacgacctctccatgtggtcggacatggtggcccgctcgatccgggcggcgggcggccgacccggcgacaaggtgcatgtggcctacgggtacggcctgttcaccggcggactcggcgcgcactacggcgccgaacgcctcggctgtacggtcatccccgcgtccggcggtatgacggcacgccaggtccagctgatccaggacctgaaacccgagatcatcatggtgaccccttcgtacatgctgacgctcctcgacgagttcgagcgccagggcgtcgacccgcgcggcacctccctgcgcgtcggaatcttcggggccgagccctggaccgaggagatgcggcgggagatcgaggagcgcttcgcgatcgacgccgtcgacatatacgggctgtccgaggtgatcgggcccggtgtggcgcaggagtgcgtggagaccaaggacgggctgcatgtgtgggaggaccacttctttcccgaggtggtcgacccgatcaccggggaggtgctgcccgacggtgcggagggtgagctggtcttcacctcgctcaccaaggaggccatgcccgtgatccggtaccggacacgggacctgacccggctgctgcccggtacggcccgggtcttccggcggatggagaagatcaccggccgcagtgacgacatggtcatcctgcggggcgtcaatctcttccccacccagatcgaggagatcgtgctgcgtacgccgggcgtggcaccgcacttccagctgcgtctcacccgggaaggccgcctcgactcgctcaccgtacgggcggaggcccgggccggtgccacgcccgagcagcgcgacgcggccgcgggcgtcatcgccgcggccgtgaaggacggcatcggcgtctcggtcgcggtcgagatcgtcgaaccggagtcgctggagcggtcggtgggcaagatcaggcggatcgtggacctgcgacctcggtagccgcagccacaagcacagccacagccacagccacagccacagcggggcctacgcctccgcgaaccggtcccgcaactcccgcttgaggatcttcccgctcgcgttgcgcggcagctcgtccacgaacagcacccgcttgggcgccttgaagtgggcgagcttctcgcgtgcgtgggcgaggagttcggcctcggtgacctcgccgcgcgcgacgacgaccgcggtgaccgcctcgatccaccgttcgtcgggcagcccgatgacagcggcctccgcgaccccctcatgtgtgtacagcgcgtcctcgacctgccgcgaagcgaccagtacgccaccggagttgatgacgtccttcacccggtcgacgacggtgaagtacccggccgcgtcccgcacggcgaggtcccctgagcggaaccagccgtcccggaaggcctcggccgtctcttccggcttgtcccagtagccctcgcacaactgcgacgagcggtagacgatttctccctgctccccgtcggccacctccttgccggactcgtcgacgacccgcgcctcgacgaacagcacggggcgcccgcaggagtccatccgcctcttgtgctcgtcgggtccgaggaccatggacagcgggccgatctcgctctgcccgaaacagttgtagaacgccagctcgggcagccgttccttcagccgctccagtacgggcaccggcatgatcgacgccccgtagtacgccttgcgcagcccgctcaggtcgcgggtcgcgaagtcggggcggttcgacaggccgatccacacggtgggcggggcgaagaggctgtccgcgcggcccgcttcgacgaggtcgaagatctgctcggcgtcgggtgcgtcgaggatgacgttctcggcgccgaccgcgagatacggcagcaggaacacatgcatctgcgccgagtggtagagcggcagcgagtgcacgggccggtcgcccgcgctcagatcgagggcggcgatcgcgctcaggtactcctggaccagcgcacggtgcgtcatcatcgcgcccttgggaagcgcggtggtgcccgaggtgtagagcaactgcgccaggtcctcgccgcgcggctccgcaccgtcgtactgagccgtcgtggcgagccgggtgagcagggagtcgtccgcgtcgcgcagtgccagggtccggaccccgtcggccagattcccggcgaggtccgggtccgtgagcaccagcgtggcaccggactggtcgacgatgtacgccagatcgtcgccggtcaggttctgattgaccggcacatgcaccagccccgcgcgggcgcaggccaggaagccgatcagatacgcgtccgagttgtggccgtaggcgccgacccggtcgccgggggcgagtcccgtctcgcgcagggcgcgggcggcacgggagacggcctcgtcgagttccgcgtaggtccaggaacggtcgcggtagtggatcgccctgcgtgccggggtccgccgggcgctgcgccgcagcaccccgtcgaccgtgacgcttggtcccgccgtcatgacctgctccttcgtccgcctgccctggcgtgatcctcgtgccgtcgtacgagcggggtcaagctcgcggccgcccccttccgccaccgtagccgccctgtggggtgggaccacacgtactgtcaccgacccatgtggtccagggcaaggccgatgactccggtcgctccggcgacgagtacacgcaggggaatcgatctcctgatgccgaaccgcccccgggcgttcccgagggcggttcggcatcaggacgggcgagtgggtcgccgtgcgacagacccgaggggcgagctggatcacacctttcgggtgcgtccctcccagtacggatcccgcagccgccgcttgtacagcttcccgttggggtcgcgcggcatcgtctcgatgaagtcgacgctcttggggcgcttgtacccggcgagccgctgttcgcagtggccgaggatgtcggcggcgagcgccgggcccgggtcgtgccccggggcaggctccaccaccgccttgacctcctcgccccagtcgtcgtgcgggatgccgaaggcggccgcgtcggcgacggcggggtgggcgagcagcgccgcctcgatctccgccgggtagatgttgaccccgccggagatgatcatgtcgatcttgcggtcgcggaggaagagatagccctcctcgtcgagacagcccaggtcgccgacggtgaagaagtcgccgatgcggttcttcttcgtcttggcctcgtccttgtggtacgagaatccgccggtgctcatcttcatgtagacggtgccgagttcacccgccggcagccggttgccttcgtcgtcgaagatcgcgagttcgctgatgggccaggccttgccgaccgtgccgggcttcttcagccagtcctcggcggtggcgaaggcgccgccgccctcactggcggcgtagtactcctccacactgtcgccccaccacgtgatcatcgcccgcttcacatggtcggggcagggcgcggcgccgtggatggcgtgccgcatcgacgagacgtcgtaacgccccttcacctcctcggggagtgccagcaggcggtggaactgggtcgggaccatgtgtgtgtgcgtgcacctgtgggtgtcgatgaggcggagcatctcctcgggcgtccatttgtccatcaggaccagacggtgcccgatgtgcagggacgcgcccgcgaactggagcaccgccgtgtggtacagcggcgagcagaccaggtgcacattgccctcgaacggcttgatgccgaagatcccgaggaagccgccgaggtatgtctcctcgggcagcttgccgggcagcggtcgccggatgccgcgcggccggcccgtggtgcccgaggtgtagttcatgacccagccaagggtgcggtcggcgggcgccgacccgggctgtccgtcgaggagttcggcgtacggccggaagccgtcgatcgcgccgaccgcgtacctctgctctgctggcagtttcgcctcgtcggcggcgtggcgcgcggagtccgcgaaccgctcgtgcgcgatgagcaccttggcgccggagtcggcgacgatccaggcgatctcggggccgacgagatggtggttgacggggacgaggtagaggccggcctgggacgcggccagatacgcggtgaagaactcgacaccgttgggcaggacgaccgcgaaggcgtcgccgcgttcgaggcccgcggcgcgcagtccgtgcaccagccggttgaccgaagcgtgcagtcgtccggcggtccactcctcgccgtcgggggcgatcaggaccgtacgctccgggtccgcggcggcctgggaccagaagccgttggggggcacgctcactgctgactccttccggcgatgcggttgacgcggtcgacggcccgctcgaagccccgtgtcaggtcgtcgaagacggcctggacgctgcgctcgctgttcatgcgtccgacgatctgcccgacgggcgtgccgagcagcggctcgacctcgtacttctggatgcgggagaccgcctcggcgaccagcagtccctggaggggcatggggagcgtgccgggcccgttcgggtcgtcccaggcgtcggtccactcggtgcgcagctgccgggccggcttgccggtcagggctcgggagcggacggtgtcgccggagccggcggcgagcagtttccggatcagcgcgggcgaggggagttcggcctctgtcgtggtcagccagagggagcccagccacacgccctgggcgcccaggctcagcgcggcggccacctgtcgcccgctgccgatgccgcccgcggccaggacgggcaacgggtcgacggcgtcgacgacttcgggggtgagcaccatggaggcgatgtcgccggtgtggccgccggcctcgtagccctgggcgacgacgacgtcgatgcccgcctcggcgtgcttgcgggcgtgccgggcgctgcccgcgagcgccgcgacgagcacgccctggccgtgggcgcgctcgacgacgtcacccggcggcgagccgagcgcgttggcgagcagcttgatcgggtagtcgaaggcgacgtcgagctgggtgcgggccacccgctccatccacccggtgatgcgccagccggacacctcgccctccgccagctccggcacgccgtacttggccagggtgtccctgacgtactgccggtgcccctcggggatcatcgcctcgacgtcggcctccgtgacgccctccaccttcttggcgggcatgacgacatccaggccgtacggttttccgtcgacgttcgcctcgagccagtcgaggtcgcgcttgaggtcgtccggtgcggtgtagcggaccgcgccgagcacaccgaaaccgccggcccggctgatggccgcggcgacggcgggaaacggcgtgaagccgaagatggcgtgctcgactcccagtctcttgctcagctccgtctgcatggccgcagaatgccgcagccctccggacgaaggaaggccttttctgatactccgtcagattccttgttccgcacgtcccgttgacacaccccaccgctgacacgaaagtttcaccccgcggggcgaacctcgaaagatactttcaggcggtgcgacgggaggcttttcgatgaccgaagacacggcggacagcgggacgggcgggcgtggacccacccgccgtcacctggtcagacgtgcgctggccctgggcggcgccctggccgtcgcccctttcccggccggccccgcgaaggccgttccaccgcctcgccacccccaccgcaccctgcggcacggctcccccgaacgcgccggactgctcccggaccacctccgcggactcgtcaccgacgccgagtccttcctcggcccctcccccacgcacccctggtacgccggtgccgtgctgctcgcggggcggggcgacacggtggccctgcatcagcccatcggcacggcggtgcgctactcggcgtacgacgcgaagaccgacacgggcgtcgagttcccggccgagcggcagatcccgatggccacggacaccgtcttcgacctcgcctcggtgtcgaagctgttcacctcgctgctcgccgtgcagcaactggagcgcggcgcgctggagctggaggccagggtcgcctcgtacctcccggacttcgccggcgcgggcaagcaggacgtcaccatccgtcaactcctcacccacacctcgggtttccgcgcctggctgcctctctacaaggcaccgagccgcgcggagaagctgcgcctcatctggaacgaggcaccgctcagcccgccgggcaccaagtacctctactcggatctgaacctgatctcgctccagctcgtcctggaagagatcaccggtcaccctttggacgccctgctccgcgacgagatcaccgctccgctcggcctgcgcagcacccgctacaacccgcccgccgcctggaaaccgaggatcgcggcgacggaggacgcacgcccgccgtggtccgggctcgaccgcggactcgtctggggcgaggtgcacgacgagaacgccttcggcttcggcggagtggcaggccacgcgggtgtcttctcctgcgcatgggacctcgcggtcctcggccggaccctgctcaacggcggcacgtacgggcacacccgcatcctggcgccggagtcggtggagctgctgttcaccgacttcaacaccgccttccccggcgacgagcacgggctcggcttcgagctctaccagcactggtacatgggcgcgatggccaccccgcgcaccgccgggcacaccggcttcaccggcacctcgctcgtcctcgacccgacgacggactccttcctgatcgtgctgggcaactccgttcatcccgtgcgcacttggcgatccggctccgctccccgggcggccgcggggaaccatctggcgcgagccgtccaggtccggcccgcgcgcggacgtacgtcctggttctcgggcatggcgaccgcggcctccgcgacgctgacactgcccgagctcgacacggccggtaccgcggataccgccgaaaccaccggcaccgccgacagcaccaccgccgacagcggggggcggcttcgctgcgccctgtggtgggacaccgaaccccggtcggacaccctcttcctggaggcctcggccgacgacggcgcgagctggcagccggtgccgttcacgaccgcgtgtgacggggaggaggcgcgggagcaccccacgggctcggtcaccggctggtcggggcgggtgtggcaccggctccacgcggacctgccgcgggcgcgccggctgacgctgcggtggcggtacacgaccgaccggttgtacgtgggccggggcgcgtacgtcgacgcggtgcgggtcgagtccggcggccgggtcctcttcgacgaggcacgtccgacggacgcggcgcgcatcgaggcggcaggctggacgccgtccgagaactgatccttcccggcatcacccttccccacttgcccagacttgtccatttttgttgtgccgaccggggatgtgccgcaaatggcccaccgtgacggtcacgaaccgtcgttcacgccgtggaggcggaccggggtgaccgggctgctggaggatgactccgggcgcgtcaccggcgtccggtacgtcgacgagcacggctcgccgggcgagctggccgccgacctcaccgtcgcctgcgacggacgcgactcgtcggtccgccgggcggccggactcgagccctcgtacttcgaagtccccatggacgtctggcaggtgcgcgtccccgcccgtgatccgctcaaggagggccgggtctcgctgaccgtccgggacggccagttcgccgccacgctggaccgcggcgactactaccagacgtcctatctcatcaagaagggcacggacggcgcactccgccccatggcatcgagtggttccgcgaccggctcggcgagctgctcggctgggaccgtacggcgacggacgccatccgctcctgggacgacgtgaagctgctggaggtcaccatggggcgactggaccgctggtaccgggaggggctgctctgcatcggggacgcggcgcacatcatgtcgccgatcggcggggtcggggtcaatctggcggtgcaggactcggtggcagccgccgcctgctcgccgggccgctgcgggaatcgacggtcacctcccgcgacctggcccgcgtgcagaagcggcgcaggctccccaccgcgttcacgcagaggtcccaactcgccgaacacgagatgctgttgcgtcccggactcgacggcacgctgcgagcggaccgcctccccgtgccgctgcgggcggtacagcacgtccccgcgctgcgctcggtcgccggctacctcggcgggatcgggatacgtcccgaacgcgcccccgagttcgcccggcgctgagccctctctagcgtcgtcgtggggtgcggcactcgatggcgttcagtgtgaacgtctccagctcgtccgccgccgcgtccaggtcgagttcggggtgggagagccagtgcgcgaccaccccatcgatcgcgccgccgatggccaaagacgtgacctgggcgtcgaactcccggaagtcaccggccttctgtcccgtcgtcagcaaggccgcgagctcttcccagcggccgcccgtgtcatggccgccgggctccttcaaccgcgtcccgcccccgtcgccgaggagcatctcggtgatcacgcgcacatggcggcggttggcctgctggtagccgaccatcgcccggacgtacgcgaccacggcggcccgcgggtcggacgccacgaggacacgctcggtgacgaacgcccggaactgctccagcacgtacgcgaacgtcgccttggtcaggttgtccttggacgagaagtggtaaaggatcgcggccttcgagagtccggccgcctccgcgatggccgagagcgaggtcgccggatagccctgcgtggagatcaggtcgatggtgcactcgatgatctgcctgcggcgggcctgctcggtgaaggtgggggtgcggtccccgcgacgcgaactcatcgccaccgagcctatcccagcgcacgctccccgacgtcttccagggcggccatcgccgcgttgtgccccggcaccccgctcaccccgccgccgcgcacggcgcccgccccgcacagcagtacattcgcgtgcgcggtctccacgccccagcggcccgtgccctcctgtgcgtaggggaaggcgaggtcgcggtggaagatgttgccgccgggcagccgcagatcgcgctcgaggtccagcggagacttggcctcgatacaggggcgcccctccgcgtcggtcgccagacagtccacgagcggttcggcgaggtgggcgtccagctgcgcgagagtcgacttcagcagctcctcccgtacgccctcgttgtcgcgttcgaacagccgcgcgggcgtgtgcagaccgaagagggtgagggtctggtagccctgttcgaccaggtccgggccgaggatggtcgggtcggtgagcgagtggcagtagatctcggagggcggcgcctcgggcaacgacccggcggcggcctgggcgtgggcagccgcgagctgctcatagccctcggcgatgtggaaggtgccggcgaacgcctcgcgcgggtcgacggcggtgtcgcgcagtgcgggcagccgcttgagcagcatgttcaccttgagctgggcaccctcggctgggacgggcgggctgtcgccggtgaggcgggccagctcctgcggtgcggcgttgacgaggacgtggcgggcggagacggtcccttccccgtccgcgtcgcggtaggtgacctcggccgagcgtccgtcggtctcgatgcggaccgcctcgtgcccggtggcgagcaccgcgccggcgtcccgggcggcggcggccagcgcgtcggtgagcgcgcccatgccgccgacgggcacgtcccaggcgccggtcccaccgccgatgatgtggtagaggaagcagcggttctgccgcagggaggggtcgtgggcgtcggcgaaggtgccgatgagcgcgtcggtgaggacgaccccgcggaccaggtcgtcggtgaagttctcctcgatggcggcaccgatcggctcctcgaacagcacgcgccacgcgtcctcgtcgtcgacgcgtcggcgcagctcgtcgcgcgagggcaggggctcggtgagcgtggggaacacctgccgggcgacacggcccgtcatgccgtagaagcgctgccaggactcgtactcgcgcgcggagccggtcagccggccgaaggcctcacgggtgcggcgctcgccgccgccgacgagcagtccggtgggccgcccgtgccgctcggcgggcgtgtacgaggacaccgtgcggccccgcacccggaagtcgagcccgaggtcccgcacgatcttccggggcaacaggctgaccaggtacgagtagcgcgacagccgggcgtctacgccggcgaagggccgcgtggacaccgcggcgcccccggtgttccccagccgctccaggaccagcacggaccgcccggcgcgggccaggtaggcggcggcgaccagcccgttgtggcccccgccgacgatcacggcgtcgaatcgaccgggtacgtgtccctcatcagcagccatggttcttggtagcacgcgatgatctaggtcggccagaggtgtgtgccacagggcccaacaatcgtccggcctgtcggcgccgttttgcctgtcgatgccgcccggccagtccgtgccgcccggcccttcggtgccgtccggcctgtcggtgccgttttgcctgtcaatgccgcccggcccttgggtgccgcccggcccgtcggtgccgcccggcccgtccgtgccgtccagcccgtccgtggagaagacgccggtgcgaagcggtccgccgcgcggctcgtggccgagccggccgctcagtggccgcccgacgcgcgccgctgccgtaacgccgccactcgccggtacagctccaccgcctcctgcccccggcccagctgttccagacagtgggcctcgtcgttgcggctggcgagggtgtcggggtggtcggggccgaggacgtgttcgcgggccgtggcgacgtgtcggtactcggtgagggcgtcggaccagcggccgagccagccgaggccgacggcgacctcgcggcggctgacgagcgtgtccgggtgatcggcgcccagcacccgctcgcggagggcgcacacgtcacgggactcggcgagcgcctcctcccagcggccgagccggccgaggttgacgccgaggccgtggcgggcgcgcagggtctcgggatgggcggggccgtggacgcgggtacggtcctcgacgaggtcgcggtagagcttcagggcctcggcgctgcggcccagccggccgaggctgataccgacctcgtagcgggcggcgagcgtgtccgcgtggtcggggccgagggcctgcgcgcgggcctcggcgacctcctgatacgccgccagggcctcgggccagcggcccaactggccgagcgcgtaggcgacttcgtaccgggtgaccagtgtgtcggggtgggtcgcgccgagcacccgggcccgggcggcggccacttcgcgggccatgcggtacgagtcctccaggcgaccgagccggctcaggttgaaggcgaggttgtggcggcagcgcagggtgtccgggtggtcggggcccatggtgcgctcacgggcggcgagcaccgacgtgtacacctggtgcgcgtcgaagtgctgccccaactggcccagtacgtaggccatttcctgccgggcggccagcgtctcggggtggtcggcgccgagcacccgctccctggcctgggccacgtgcgcgtactcgcgcagcgcgtcggcggggcggccggtgcggctgagcgtgaagccgacctcgtagcggctggcgagtgtgtcggggtggtcggggccgagggcgtgttcgcgctcggcggcgacggcacggtgcacctcccccgcctccgcccagcggccgagccgcccaaggctcagccccgcgttgtggcgcccggtgagggtgctcaccaactcgggtgagggggtggggcgttcactgcgtacgggtgccggggcgcggcccgtgtcggggcgggcgacccattcgccggtgaggcccgcgccggcgtccggcggggcggcgccgaggccggttccggtggccttgtggccggtggtcatcccgcgggtccaggagggcagccggggctcgcgggacagccgccgctccgggcgcgacggggccgggggcgccgacaggtccggcagcggggacgacgtcaccacggtcggcacataggcgggcgtgccgcgtccggcgccgatgcggcgggccagctcgcgggcgtcgtgcggacgctcgtcgggcagcttggcgagcaggtcgaggatgatcttctcgaagtacgcgggcagttcgggacggtggccgcgcggcggatcgggcggggtgtcgcggtgcccgatgaggatcgcccaggcgtcgtcgaggtcgaacggcggcgccccggtggcgatctcgtacagcacgcagccgaacgaatagaggtcgctgcgctggtcgaccggggagccactgatctgctccggcgacatgtagtgcggtgtgcccatcgcgatgccggtgccggtgaggcgtgcggtgaagccgatgtcgtggccgaggcgggcgatgccgaagtcgcagatcttcacggtgccgtcggcgagccgcatgatgttggcgggcttcagatcacggtggacgatgccctgttgatgggtgtacgcgagggcggcggcgacctgctcggcgatctcgacgacatcggcgaccggcagcggatggtgcttgttgtcctccaggagctggctgaggttgcggccctccagcagttccatcaccagaaacagcaccccgtcggactcgccgaagtcgtggacgacggtcaccccgcggtgctggagggcggcggccacccgggcctcgcgccgaaaccgctcccgcaggacgcgcgtgaaggactggtcgtggtgcgtgctgagaggcttgaggcacttcacggcgacctgacggcccagcgactcgtctctcgcccgccacacctcgcccatgccaccgcgcccgatcaggtcgagcagccggtaccggccctggaccagcctggtgtccgccatcgcccgcgatcgcccccgtctttggcccccgccctcccctggcccgtccagtatggcgagctatgcgccgagtttgtacggtgccgggcgcgagccggggccgagccgtgacatggcccggataatgtgtttgggcgggagttgccagcgcagacgtgcgggaacacagcgcagcaaggtgccggtgcaacgcaggcgccgggtcaccgtggcgggcggcggccccggtcggccgtacagctcatgggcgtacggcggcagagcggcgtacgccagatgagccacgcgccgccacagcagggcgcgcgccgggatgagcaacgggtggatgggcgggctctgcaggaagtcgtccacctctcgcgcctccggaccggcggtcagttccggccgcaccttctcgaagtacgcggcgagcccggcccggtcccccggtacgccgcccgggtcgagccccaccaggcgtgcggtgacccggtgttcggcgatgtagcggtcggcctgcgcgtcggtcagcgggacccccgagcggcgcaggacgtgcagataggagtcgatctcggcgcagtgcacccagagcagcaggtccggctcgtcgaccccgtaccgctcccccgtgccggggtccttcgccgccagcatgctgtggatcttccgcacccgggccccggcccgctcggcggcctcggtgctgccgtaggtcgtcgtgccgacgaagtcggcggtgcgcatcagccggccccaggcgtcgcgccggaagtcggagttctgcaggaccccgcgcaccactcgcgggtgcagggcctggaggtagagcgcgcggattccggcgacccacatcatggggtcgccgtgcatctgccaggccaccgaggacgggccgaagagccccgggtcacctgcgtgagaggcctccaccaggtcaggctaacgccgcacgcgcggcatccccagaccgatccacgagatgatctcgcgctggatctcgttgttgccgccgccgaaggtgaagatgaccgccgaacggtagccgcgttccagttcaccgtggagcaccgcgcccgccgagccctccttgagagcgccggccgcggcgacgatctccatcagccaggcgtacgcgtcccggcgggcctcggagccgtagaccttgacggccgaggcgtcctggggggtgagcgtgccttcctggacggcgttcaccatctgccagttgaggagcttcatcgcgtcgagcctggtgtgggtccgcgcgagatcgcggcgcacccaggggaggtcgacgacccggcggccgtccgcgagcttggtctccatcgcccagcgctgtacgtcgcgcagggcccggatcgccatcgtgccgtgcgcggcgagggtgacgcgctcgtggttgagctggttggttatcagccgccagcccttgttctcctcgccgacccggcgggagacggggacgcggatgtcctcgtagtagctcgcggtggtgtcgtgcgaggcgagggtggtgatgagggtgcaggagtagccggggtcggaggtcggcacgagcagcatggtgatgcccttgtgcggcggggcgtcgggatccgtgcggacggcgagccacacccagtcggccgtgtcgccgttcgtcgtccagatcttctggccgttgacgaggtactcgtcgccgtccctgacggccttcgtcttcagtgcggccaggtccgtgcccgcgtccggctcgctgtagccgatcgcgaagtcgatctcgccggagaggatcttcggcaggaagtacgccttctgctcgtccgtgccgaaccgcatgatcgtcgggccgacggtgttgagtgccatcaggggcaggggcacgcccgcctgggccgcctcgtcgaagaagatgaactgctcgatgggcgtcagtccgcgcccgccgtactccttgggccagcccacgccgagccagccgtccctgccgagccggcggacggtgtcgcggtagaagcgtttctgcgcggccgggtcggtgtagcgggcataggcgtttcccggcaccagatcggcgaagtagccgcgcagttcggtgcgcaaccgctgctgctcgggcgtgtattcgagatgcacggcgcctcccggctcccaggggctcgacggggtcccctcgacctgacggcgcacacagtagaacttgttccagaaattgggaacaagcgggagcatggtcggcacccggggggaagtgcgtccacccgggggcgtcgaggatccggccgcgggggccgcgcgggccagggccgggtgagcgctcgggacgccggttgtcgcaccaccgggttcgtgcgcggcggcgtcggctgcgacgtcagacgagggtcgccatgaagtccgcacaggcctgggcgcattcacggcaggccttcgcgctgttctccgctccggggtggtcgtcgaagacgtgcgcgcactcgaggcagacggtccggcaccactccagttggatgcgcagggtttcctcgtcctgccgggcctgctcggacagcacccggcaggtcgcgtcgcacacttccgcgcacatgatgcccttgcggcgcacgagttcctgcccctccggtccgtccggaccggcgaagctcgcccgcagggcgcacgcccgcgcacattcggtgcaggcctgcgcgcaggtgaagcggtcctccaggaaccggaagagttcctgtggagaggccccgtcggggaatggatcagggggtgtcccgggggtcgtccgggagggaatgcgggaggccgcgcgggcggtcctgcgagaggtcgtcgaagtcacaccgcgcgggtagccgtaggcggtcgcgccaaacccggagcccagggccggtcggctcccccggccgcatcatggccggaccgggatgcgcggacggccccacgccggccgggggcgcacggcggtccttccctcccggccgagcgtctcgacgggacggccccgccgggggcgagagccgcggcggccccttcggcagcggggcccgcgagcgcctgagcagcgctcttcgctacgcgcccgcgccctgtgccgcctcgcgtgcgatgcggtcgaactgggcgcccatcgcctcggacagggccacggccgccgtcagcgggcggaccatgatcatgaagtcgtcgatcctgccgtcctcgtcgaagtgcaggaagtcgcagccggtgatcgtcttgtcgcccactttcgcctcgaagacgagcgcatggtcgcggccctcggcgccggcgatctcgcggacgtagcggaagtcggtgaagacgcggctgacgccccgcaggatggccgcggtgatcgcctttcccgggtagggcttgaaggcgacggggctggtgaagacgacgtcctcggccagcaacgcctcgatcgcggcgtggtcgccggcctcgaccgccttgcggaagggatgcatcgcgtccgcctctcatactcaactaattgattaggtgcagaggagattaatcgcagaatgctccgaccgtctagccttggcgcatggcattgcgcaacgcggtcctcgccgccctcctggagggcgaggcatcgggatacgacctggcgaagagcttcgacgcgtcggtggccaacttctggatggcgaccccgcagcagctgtaccgggagctggaccgcatggagtccgacgggctgatcgaggcccggctggtgcggcaggaacggcgcccgaacaagcggctgttctccctgacggcagcgggccgggcggcgctgcgcgacttcacggccacgccgtcgaggccgaccgcgatccgggacgagttgctggtcaaggtccactccgtcgacgacggcgacaccgaggccgtacgggcggcgatcgccgagcgcctggagtgggcgcgcgcgaaactggcccgctacgaccgcatccgcacccgtctgctggacggccgcggtgaggaggagttcctggccgacgccgagcgcgtgggcccgtacctcaccctcctgcgcggccgcgctttcgaacgggagaacatcgagtgggcggagcgggccctgcgggtcctcgaacaacgccccgcgcacaggtcgcgctagcaccgctccagggtgcgcgggtgatcgccgagcccgacgtacgtccacggtcggcacgccctcgtccgctcaccagctcaccagctcgtcagctcgtcagctcgtcagcggaccacgatccgccggccggtgacgccgacgggatcgacgcacacccaggtgtcgcgctcaccgccggcccacgggccgctgtacgccagttccgccagccggcgcagggtgtcggggtccgtcaccagccgggcgaggccgcgtacgagcacgctccagccctggctgagcgcctcgtcgatgtggtcgacctcgaaggcgacccgggagcccgcggacgccgccggctcgctgtcggccgctgtcctgaagcagacgaccccgtcgacgacgctgtagttcagggggacgatgacggggccggtgggagtgtccaccgcgagcctgccgaccccgtgcgtcgacaaccgtgcccggcactcctcgtcgctcagctcgagcagctcgggatgggcggccgcccggcccacgcccggtggaaggtccgcgtcgccgccccgcagggccaccacggtggtctccagggcgtcggcgagccggatgaggacgttggtgctcggcagggcggtggcctgttcttccaggtactggaggtagcccgggtccgtaccggcccggccggccgtttcctcccgggtcagaccgagctcttcgcgtcgttgggtgatacgacgccccacgtctccccgcgcggtgcccgccgacgcggacgacgtgttcggtgatgcctcttcggacatgaccgctcacttccttggctcaggccgccctgaccatcaggacgtcgtgctgctgctcaccgaggacgaccttgagcgcgccggtatcggcggccctcgagaagacgtcgtacgcctcctccatggcgtccagcgggaaggtgtgggtgaccatggacgacgcgggcaggtggccggcggccatcatgcgcagcagggtcggagtggagcgcgtgtcgaccagtccggtggtgatcgtcacgttcttgatccacaggtcttcgaggtgcagcaccgcgggcctgccgtgcacgccgacgttggccacgtgcccgcccggccgcaccatgcgcgtgcacatctcgaaggtctcgggcaccccgaccgcttcgatgacgacgtcggccccgagccccagggtgaggtcggcgaccagtggctcggcttcctcgcccgcgacggccaccgcgtccgcgccgaggcgtttggccgcgtccagccgggccggggcgaggtccaccgcgatgatcttctcgggtgtgtagaggcgggacgtggcgacggcggcgagaccgacggggcccgcaccgaccacgacgacggtgtctccgggccgtacccgcccattgagcacgcccacctcgtaggcggtggggaggatgtcggccagcagaacggcgtccttgctgtccatcgccccgggcagcggatgcacggacagatcggcgtggggcacgcggacgtattcggcctgcgtgccgttgatcaggtggccgaggatccagcctccgccgccgcggcactgcccgtacgccgactcgcggcagaagcggcagcggccgcacgccgtgatgcacgagacgaggacacggtcgccggggcggaccgtgcgtacgtcgccgcccgtttcgacgatctcaccgacggcctcgtgaccgagcacggtgccggggcgtacctccgggagatcccccttgagaatgtgcaggtccgtcccgcagatggtgacggtgtcgacacggacgatcgcgtcgccggcgtcctggataccggggtccgccacgtcctcccagactgactctccggatccgtggaaaacgagtgctttcatgacgagccctctcctggggtctgcgcatgccggtcgcgccgggggcgtggcagcggccggacggctgcctctcctctccagcctgacggtcccggacccggctcgcacgggttgacggcccgcagagcgcggctctcacgcctcccacgtccagttcgcgacctcgggcaggtcggtgccgtgctcgcggatccaggcgtggtgccgggtacgtgcgtcggccatcgtctggcggacggcggcggcgcgtacgccgaggccggggacacggtcgacgacgtccatgaccagccggtagcggtcgaggtcgttgcggacgaccatgtcgaacggggtcgtggtggtgcccatctccttgtagccccgcacatggaggttcccgtgaccggtgcgggaataggcgaggcggtggatcagccagggatagccgtggtacgcgaagatgaccggcttgtcggtggtgaaaagcccgtcgtactcgaagtcgctcatcccgtgcgggtgtgcctcgcgcggcagcagccgcgtcatgtcgaccacgttcaccacccggacggcgagggcgggcagatgccggcgcagcagtgccgaggcggccaggacctcctgggtcggcacatcgcccgcgcaggccagcaccacgtccggttcgccgtcgttctgcgtccccgcccactcccagatccccgccccgcgcgcgcagtgggcccgggcctgttccatcgacagccagtcgaagcacggctgcttgcccgccacgaccacgttcacgtagtcacggctgcgcaggacgtggtccgccaccgacagcagggtgttggcgtccggcggcagatacacccgtacggcctcggggctcttgttgaggacgtggtcgacgaagcccgggtcctggtgcgagaaaccgttgtggtcctgacgccagacgtgtgaggtgagcagatagttgagggaggcgatcggcgcgcgccacgccaactcccgtgacgtcttcagccacttgatgtgctggttgaccatcgagtcgacgatgtgcacgaacgcctcgtagcaggagaacagtccgtggcggccggtcaggagatagccctccagccagccctggcaggtgtgttcggagaggatctccatcacccggccgtgccggtcgaggtgttcgtcgaccggaagggtctgggcctgccaggccttgccgctcgcgtcgaagacggcgtccagccggttggaggcggtctcgtcggggcccacgagccggaagtcgcgacgggcggaggtgtccttcatgacctgttcgaggaggtcgcccagaacccgcgtgggctcgtgcagggtcgcgccgggcttgtcgacggccacggcgaaccggtcgaggggcgggatcggcagcggccgtaggaggaggccgccgttggcgtgcggggtggcgcccagtcgcctggcaccgtgcggcacgcaggccagcacgtcggccgtggggcggccgtcggcgtcgaagagttcctcgggccggtacgagcgcagccagccctccagctggcgcaggtgctcggggttctcacgcacttcgggcagggggacctggtgggcgcgccaggtgccctcgacgggccggccgtcgacctccgcgggtccggtccagcccttcggtgtgcgcagcacgatcatcggccagcggatccgctcggtcgcgccctcctcgcgggccgtgcgctgcatcagggcgacgcggtccagggcccggtcgaaggcctcggccagggcacggtggacctggtgcgggtcgtcgccggtgacgtggagtggttcatggccgtatccgcgcagcagctcgtcgagttcgggctccgggatgcgggacagcaccgtcgggttggcgatcttgtagccgttgaggtggaggatggggagcacggcaccgtcgtggaccgggtcgaggaacttgttcgagtgccaggaggcggcgagcgggccggtctccgcctcgccgtcgccgatcacacaggcgacgagcaggtccggattgtcgaaggccgcgccgtacgcgtgagcgagcgagtagccgagctcaccgccctcgtggatcgagccgggcgtctccggcgcgacatgactcggcactccgccggggaacgagaactgcctgaacagcttccccatgcccgcggcgtcacgggagatgtccgggtaggtctcgctgtagctgccctcgagccaggagttggccagcacggccggcccgccgtgccccgggccccacacgcacagcgcgtccagatcgcgggccttgatgacgcggttgagatgggtgtggacgaggttgaggccgggcgaggtcccccagtggccgagcagcctcggcttgatgtgcgcggggctgaggggttcggtcagcagcgcgttggccagcagatagatctggccggcggcgagatagttggccgcccgccagtgggcgtccaacgtgcgcagttcgtcgtcggtcagtacggtgctgttctgatgttcgacctggggcatggtgactccgtaagtcgtcgagcggaggaggcggcatggccggcaagaagacggcgagggtgccgcgcgccgcatacgagcaggaactgctgcgcctgcagaccgagttggtgaagctgcaggaatgggtgcgggcggagggcgcccgtctggtcatcgtgttcgagggccgggacgcggccggcaagggcagcacgatcaaacgggtggcggaacatctcaatccgcggcaggcacggatcgtggcgctgccgaagccgaccgagcgtgagcgcacccagtggtatttccagcggtacgtcgagcatctgccggccgccggggagatcgtgttgttcgaccggagctggtacaaccgcgccggtgtcgagcacgtcatgggtttctgcaccaaggaggagcaccagctcttcctgcggcaatgtccgatcttcgaacggatgctggtcgaggaggggatcctgctgcgcaagtactggttctcggtgagcgacgccgtgcagcaggagcggttccggcgccggatgaaggatccgacgcggcgctggaagctctcgccgatggacctggagtcgatcacccgctgggaggcctactcgcgggcgaaggacgagatgctcgtccatacggacatctcggaggctccgtggttcgtcgtggagagcgacgacaagcggcgggcgcggctgaacatgatggctcatctgctcggctccgtgccctactacgaggttccgccgccggtcctcgaactgccgcgccgcccgccgtcgaccggctacgagcgaccgccacgcgatctgcagacctacgtgcccgaccacgcggcgagcctctgagccggccacggccctcacccccggtgcggtacgacggcgaccgggcaggcggagtgatgcagcatcgcgtgggcgacccggccgagctggagcccggagtgtccgggatggcgccgggcgccgacgacgagcaggtcggcggtggccgaggcgtccagcagcaccttgcgggccgggccctcgaccgcgcgccggcgcagttcgacatccggcggggccccgctcagtaccgcttccagcacctccgtggcccgctcttcgtgcagccgggccgcccttcgggaggacagcgggtggcccagggcctcgcgagcggggcggcgccaggcccgtacggcctccaccgcacagccccgtgcccgcgcctccgcgacggcgaaccgcacggcggccgggtcgtccggttcctcgccgacggcgaggacgatgcgccgatggccacccgccccggcccggttgtcctggctgccgcgcagcacgatcaccgggcagtaggcgcgggcggccacggccagggacaccgagccgaggagcagctcggcgagcccgctgcggccccgcgaccccaggaccagcgcgaaggcctcgttgccctcccgcagcagggcgggggccggctcctcgggcagcacatcggtggagatcttcacgtccgcgtggcggcggtgggcgcgctgcgcggctgcctcgacgatgtcgtcggcgatcacctgctccggaggcctgccgagcccgtcggcgagcgcggccccttcgtaccgctcccacagcgacgcgtagaccagccgcagcggaaccccgcgcagagcggcctcgtccgccgcccagtccacggcgcgcatactcgactcggagccgtcgacccccacgaccaggggaagctccatcgcactcaccttcctcaccgtcctgcgccgaagtcgaagacgatcgccgaagtcgaagacgatccgtaccgtgagccggccgctcagcacatcgtcggacacctcggtgacggaggcgagcggccgccactcacggaccgccctggtacggcccgccgcgagcggccggaagacctccgcagctcctgccgcgtagcggcgacggggcccagcgccgaggtgccgccgagcaccgtgtcgaagatcggaacctggtcgtgccgtgcgccggccgggtgaccaggactgagcctgccgcgacgccgtgggcccgaacggacggcggcgaaggcgtcctcggtcacggtgagcgcgagggcggtgtgtgcgccgcaccatcgcccgaaggtgacggcctcaccgaatccaccgggtgtccccggcggccgtggcctcactctcgcccctttccgcccgggccgcaaggcactcctgcaaccgaagatgccggaactcgtagcgtgcgccggactgccggagcacgccccgcaggtgggcctcgtgcaggaaggccatcaggcgccacggcagctgtcccgtggcgccgagccacatccttgcgacggtcaggcggccgtacgcgctcaggctcaacgccaacgggcccatgacaagcgccatttggagtgacatcccgtgcatcccgtaacggtcgggcgtggtcagcagcaacaggccgccggcggcggacccggcgacggtggcggccgcacccctggtcagcacggcgagccggtcacctcgcaggccggcgggcggactcgtggcgcgggtcaggtcggcgggtgtgtcgagccagcggtagacgccgcaggcgcagcctccgatgagccccaggacgaggcccgagacgatgcctcccttgacgcagttctccaccaggccccaacggccgatctgccagaaccaccaggcggccggcgggtgcagggacgacaggagggtgaggtcgcgcgcgtcgtgaccggcgatccggacgtgccagatcccgtcccgcgtggtgaaccgcacccgggcgagggccgtgctgcaccgccggtccaccgcgtggcatgccgcgccgggcccgggtggcgcatacgtccacgcctgtgccgggttgcggacgttcaccatcaggaccaccctgaccggctcggcgggccgggccgtcttggtgccgtcggggtaggcctcgaaggtccatgcgccggtggtcgcgcggcggattccggtgcgcgcgtccagggcggcggcatcggtgtgtacggttccggcgcgtgtggcccgccattcgatgacggtgcccatcacggctccgatggcgggaccgagtgccagaccgaccaggaggcaggcggccgtgccgcggaccagcccctggcagaaccgccggacctgctcccggcccggcacccggtggcgagaccctcgcggtccgcgccgccggatgcggatgacggccaccacggccgcgcacgcgacgacggccgccgcgctcgcccgccacagaccgccggccggggagagggggtccatgaccaggatcgccacgccggacaggaccaggagggcagccacaccgacgtggcgggcgaccgtcggcccggcccagggcagccccagcggagcggggcaagcggtgactccggccaccgcgaacaccgccgacacggccgtgccgaagagcacaccggacagaaaccggaagagccaggcgtcccccaggtcggcgatggaggcgccgtagaggggctcggccgtgacaccgatgaggatgcccagggtggcggccgccagggcggccttcgccatcagtacccgcagtgaggtcctgccggtgcggtcgatgaggacggccagccccaccacgcaaccggcgacgactcctgaggcgttgccgacgagttcgtacagttcgccgtcggcccagaggtcgatcatcgtgtgcggtgccaccagtgtcatgacggcgccggccaccacggcggacaagcacgcggccagcgcccccggcgccagcagccgcacgatccgcggcaccgcgctctgcaactcccaccaggcgaactgcccggtgtcccggttccgcaggtgacgggcgaggaacccgagccaccgctgggcgtcctcggtcgtgcggcacgatccgctggtgtcgccgaacaccgccggtacgaaggcggtgagcaggtgctcctcgatctgggcggccgtacggaaccggccgtccagcagttgtccgggatcgcggccgccgtcaccgtgcaccgcgcgggccatggcgaccatgaggggtcggctcagcacctgccgcagggcgtcctcgggcggcccgccgggcgcggccagacgagccagtgtcgcgctccaggccgtgccgatccggccgtccggcatgcgtctgggacgcgaagtccgggtcagataggacgcggcatcggtcagccgcagtggggagagttcgacgaccgccgcggccgtgagcacgtcgcaggcctccacggtggcggcgtaggcgtcggtcctgctggtgaggtacaggggcgagtcggcgtccagttcggcgttgaggcggcgcatcgccggcgtccgctgcgcctcgggcagttcgtcgaatccgtcgaggaccggcagcaccagacgggcggcgaccagggcgtccgccagtgtgccgccgcccggcactcccgccgccagggccgggaagtcggccgcgatccgagcggccgtccagacgcgcagcggttcgcggacggcgtcccaggtcccgacgggcagcacgacggggacggcgtctccgggctgccgggccgccagcagctccagggtcaggctcagcgccagaaccgtcttccccgacccgggctgccccagcacgaccacccgacgggacggaacggagaggaaggcggcgcgggcatcgctcaactgtcccgatctcagggcggtgtgtgcctcggcgccccgccgcacgttctcgtcgtggtcggccagcggcgcgtccaccgcagaccaccggacgggcagcggttccggatcctgcaacctgcgcagccgcgcctcggccgcccacatgtcctgcaccacctcggccagggcgtcggcccggcccttcagccagtccgtgccgcggccctccccggtaccggactcgctctgcgtcagggtggacagcagccccagcacggagaccacgagccccagagcgggcgtccaccgctcgatcacgctcttgccgtcggcgagcacggtgacggcgacctgagccaggccggtggccaccaacgcggccgcccaccacagtttgcgcacgcgctgcgcgtccccggcccaccgcagtgccctcatcccactcccgtttctccgcccggcggccatgccaagcggagcccggggcgttccgcaaccggcgcgcggaagcgtgaccggcgggggaacgcgagccgcaccaccacccgcccaggtgaccgccggccactcggcaggcggtcgggcccgcctgccgcgggcacgcccgggccgcagcaccgctgacgggcccccgacgggccgtgccgaggcggtgtccgcaggaccggtacggcgagtggatcaccgtccacgagggcgaccgggaccgcaccgagtaccgaagggcacggacgcggtgccgggtgtcctggtactggggccgggcggcccgtggcgcgggccggaacacaggaacatgctggaagcggcaggtccgtacccacgtcctggaggcccgtcatgaacgctccccccacgtccagcatgctccgggcgctgccgtcggagcaccggcagcagctgatgcgggtcgctctggaggtgtccttccccgaggggacgcgcctgttcgaggagggcgcacgcgcggaccgcttctgggtgatccgcaccggcgcgatcgatctcgacatgcacgttccgggccgcaaggcggttgtcatcgagactctccggcacaacgaactcgtcggctggtcctggctgttcgcgccgcacacctggcacctgggcgccgagacgacgacgccggtacgggcgtacgagttcgacgccgtggcggtccgggcgatgtgccaggaggactccgcgctgggtctcgcggtcgcgcattgggtgggcgagatcctcgctcaccgcctgcggtcgacccgcacccggctgctggacctgcacgccccctacggcagcggcagccgtcactgaccgcctcgacgcgaaccacagggcctggctgtagttggtgaagcggacatcggcagcgcagggaggcgtctaggttgggcacggtactgatcacacagcgaccgcgaggagaccctcggcatgtcgaacgtttcgttaccccgcgacgaaggccgcgcccacgtggcccggctccgcaccgatgtgtcgcactcggcccgcatctggaactactggctgggcggcaaggacaactaccccgtcgacgaggaagtcggcgatcagatcctgggtttcgtaccggccctgccccggtccgccgtggccgaccggcagttcctcgcgcgcgccgtggggttcctcgccggcgaggcgggcatccggcagttcctggacatcggcacaggactgcccacggtcgacaacacccatgaggtcgcccagcgggtcgacccgacctgccgaatcgtttatgtggacaacgaccccatcgtgctccggcacgcccacgccctgctcaccagcacccccgagggggccacggactacatcgacgccgatgtgcacgacccggacgccatcctggaacgcgccgcccgcaccctggacttcagccggccggtcgccctcacgatgctcggcgtcgtcaacttcatcatggacaccgaccgggcccgggccatcgtccggcggcttctggacggtgtgccgtccggcagctatctggtgatctcccatcccaccaccgaggtggacggcgaggcgatgacggaagcggtgcgctactggaacagccagggctcggcgccgatgaccctgcgcacccgcgaggagctgctgcggctcttcgacggcgtggatgtgctcgagccgggtgtcgtctcgtgctcgcgctggcgcccggccccgtcggggaaggacgagatcgtggacgtgacgcacttctgcggcgtggccaagaagccgtagggcgtgggacacccgtccacgtcgtccaccccggcgtgcgccccggccccgcggtgcccgcacgctcggaaccggactcggtacgcgtaccgatcggcgcacgatcggcgtctcccccggcatccgcgccggcatgccggctgtcgccctccagcgcggcgccggccggaccaggtggagacggcccgcgtcggccgccgaccggccgacggcctcggtcgggcagcacctaccagggaaggatgccgtcggcatcgaagtagcctccggtggggccatcagggtccacctgcgccatacgcacgatgatctcggcgccctgctcgacggtctggacaccgctgtttccgttcaggtcggtcttggtgtagccaggctccaccgcgttgatccgcatgttcgggaacgccttcgcgtactgcacggtgatcatgttgaccgcggtcttcgaggccgggtaggccaagcccgggtaggtgtacgccgggtcgcccgggatggtggcccgggtcagcgaggccagaccgctgctgacgttgaccacgaccggggcggcggaactccgcagcagcgggagaaacgcgtgggtgacgcgcaccatgccgaagacgttcgtctcgaacgtctgtcgcatcacgtcgacggtcacgtccgccgcgccgatcacgacgttgtcgtcacccatctcttcttggatgccggcgttgttgaccagtacgtccagccctccgtcggcctcgatggtcttcgccgcggccgccacggacgcgtcgtcggtgacatcgagccggaccgcccgcgcgcccagccgctcggcggcccgacgcccgcgttcggcgtcccggcttccgatgtagacggtgtggcccgcggcgatgagccggcgggcggtctcgaagccgagacccttgttcgctccggtgatcagtgttgctgtcatgcctccacgatgcggcggagccgcgcggtcagccagacgtcctgtgctcctgggactgatcagtaccaggggaccgtggtgccgccgaagatgctcagcagggcgctgcgtcgccataggtgcgggcagacggtggcggccaggggcccgagccggtcaccgcccgctgccccggccgcgagcgggctggtgacctccgcgcgtcacgacgtgccgtcggccggaagctccaggcgcagttcgtagccgccgtcggccgtggggccggaggtgacggtgccaccgaggagtgcggcgcgctgacgcaggccgatcaggccgtagtgcgcgctgggcaggggcagagcgggccgggtcggtgcggtattggtgaccgtggcacggacggcgccgttctcctggcggatacgaaccgtcgcggtggtgccgggggcgtgcttgcgtgcgttggtcagcgcttcctggacggtgcggtagatggcgcgctggactgtgggcggaaggccgtcaggcatgtccgcctgaagttcggcctcgatgccgctgttgtcgaccagccgctggaggtcggccagggacggctgcggtgtcagctccgtggggcggcctccggaggcgcgcaggacgctgaccatgtgccgcagttcgtccagggtctgcacgctcagccgccggatcgtggccgcggcttccttgacgtcggcgtcctgggtgccgacctggagtgctccggcccgcaccgcgatcaggctgacctggtgggagaccacgtcatgcatctcccgcgcgagctgcgcgcgctccttggccagcacggtctggtcggtcaggagccgctcgtggtcacgcgccgcggagatctcggcgagtcgcaacgacagatcacgccgggcctggacgagctggccgaggaagaccggagcgaccgccgtcgccccggtgtaccccagcgtgatcagggtcgcggtctccgacaggtcgaacgtcggtgacggccacgaggacatgctgctcaacgtgaacgccgtggcgcaggcggccagcaggacacggtggcgggtgagtgaggcgagtgtgtacagcgcgatcagtgcggcgaggatcgcgtcggagaacaggacggcgggcagggtgagcaggaaggtcagcagcggcaggcgacggcgcagcaccagagcgaaggccgctgccacggcgcacgccatgcgccccggctcgtccgagtcgaaatggacccagacgtctagcagcgccaccgcgacgactatggcgtccagcagcggggcgggcaggcggcggggggtcattccccctcctggtcccgtggtggcttgagaaggccggcccgttcggcgagcagggctgcctggacgcggccgtccaccttcagtttcgtgaggatggcgctcacatggtctttgacggtgccggtgctcaggtgcatccgggtgccgatgtcggcgttggacagtccctcggcgatgaggacgagtacggcgcgctcgcggtcggtcagtgcggcgaggctgcgggcagcgggctcctggggtccggcgttcagatagccgtccacgaccgtccgggtgaccttggacgccagcacggtgccaccgtcggccagggtccgcacgaggaacggaagcccctcggggtcggtgtccttgagcaggaagccggcggcgcccgagcgaagtgccgtggccacgtattcgtccatgtcgaaggtcgtgagcatggccaccaccggagggtgcggcagccgacggaggcaggccaggagggtgaggccgtcgacgtccggcatccggatgtcgagcagcacgacatcaggtcgtatctcctgtgccgtctgaagcgcctggccgccaggaaccgccgccacgacctcgatgtcgtccgccgtgtcgaggatgtgctggaaacccgtacgaatcagggcctcgtcgtcgacgaccaatacccggatcacgcatgctccactcactatcggaccactgtccgattcgtaccacgtcgagagacgccccgcgggttcccgacaccgaatccggtcaggcggcgggggctgcgccagccagtcggcggggcggttccggacacctgccggatggtcctgaccggcggcgtctccgaccctggatcacatgacgcacgtcgtagcagaggccgcgccggccgaggcgatgtcggctgcgcgggcaggcccttcccgtacgtcgtccacaggacggctgatcggcctcgacctggcccgtggcctggcggttatcggcatgtacacggcccacctcggtaccgacccctcggagggcggcccactgggctgggtgacggaggtgacccgtgggcggttccccgcactgttcgctctgctggccgggttcaccctgatcattctcaccggtcggccacagccgcggaccgggcgcgcggggcgccaggccatgggcagggtactgatccgctccgccgtgctgatcgccctgggatatgccctggcgtacctggacaccccgatcgacgtgatcctcgccgcctacggagtgatcttcgccctcgcccttccgctgtaccggctgcgcgcctccaccctggccgtcatcgccgcggcgatgacgctcgtaatgccccccgtcgtgtatctgctgcgggccgcggtcgagggcggcagctgggccgatgccgtgatcgccaacgatcctctggcccgggtcaccggttcggacgggatcctcgaattgttcatcaccggcgagtacccggtactgacctggctgcccttcgtcatcgccgggatggcggtggcgcggctcgacctcagccggcccggtatccgcgccaggatcgccctcctcggcggcgcacttgccgtactcggttacggcggctcctggctggccctgcacctggttccgggcgcgcaggccaccgtgagcgcggcgacggacggcgggtcggcgtcatcggcctggtggtccgatgccgtcggcgaccccaccaccagtaccccggactggatgctggtggccgcgccgcacagccagacgacctggtcgatcctgggcaacaccggcttcgccctcgtgatcctcgctgtctgcctcatcgccacggaccggtcggcgcgcctgcggtggttcgccacacccgtcaccgcggtcggctccgtcgccctcaccgcctatgtcggtcacatcgtggccatcaaggccctgggcatggacgacgtgccgacctccgacgccctggcggtcctgatcggtttcgcctcggtcgccatgctgctggccctcgcctggacccgggtcttccggcgcggaccactggaatacctggtgcacgccgccaccacacccgcccgtctgatcaactgactggcggtggacgaccaatgcccgtaggagacactccctccaccgacgattccgcaacacccacggatttcgacggtctcgcaccatccggcgtcacgccgggccagcaaggaggtaagccgatgacagtccgcctgacattcatgtgcgcgacagccgggggcaccaccagggatgcggtcttcggtgacggtctcctcagtgagcgcggcctgcgccgggcacgcgccgccggcgcaacactccccccgtactcgctggccatccgtgcgccgtcggtccgctgcgcgcagaccgcttacgccctcggcctgccgaccacactcgagcccgcactgcgcgacctcgactacggcacgtggcggggccgcacagtcggcgaggtcgtcgcggacgaaccgtacggttactccgcctggcttacggacccggatgccgcgccacacggaggcgagtccgtacgccggctctgccgccgaatcgccaactggctgagcagcgtgccgccttacccgggccgcgcgttggtcatcacggaaccgtcggtggtccgggcctcgctcgtccatgctctgtccgcaccagtgacagccttccggcatttcgatgtgccgcccctgtccacggtctcccttaccttgagcgacggccactggatcgtccggcccggccgtgtcaccccggacagagtcggcaccagtcgcgctgttcccacgccctatgacgccgccgagggccggacggcgctcctgtggggcgaggcgaccccggcgtagcggcggggtacaggtacagcggttgtgcggagtcgtcggcgcccggatcgcaagttcgtcgacagatcgacgagttcggccgaacaacgagttcggccgaacgacgactccagccgaacgacgacttcgacatgaaggtcgtcgacatgttcaccacgggatgcctcccgcccaccggcgaccaccgtcgcgcggggtgaccatgtacagaacgggcgcgggacaacaccggtcacgaatccgagagtgtcgttacacgtgaccatcatgcccgaagcgccgatactgccgggtgtgggctgttcgacccgcccatgtgcgcaacaaccgaacaagatcaacaaccggtcgtacacgttctgaccaggaaagatactggtcaggggctaagctggagatctcaccgggaggcacccatgaagatgctcatcaacgtcgcggagacggtggtcgcggacgcgctgcgggggatggcggccgcgcatccggagctgacggtggacgtggagaagcgggtgatcgtccggcgcgacgcaccggtggccggaaaggtcgggctcgtctccggcggcggctcgggacacgagccgctccacggcggcttcgtgggcccgggcatgctctcggcggcctgtcccggcgaggtcttcacgtctcccgtgccggaccagatggtgcgggccgcggccgccgtggacagcggcgcgggtgtgctgttcatcgtgaagaactacacgggtgacgtcctgaacttcgacatggcggcggaactcgccgaggacgagggcgttcaggtcgcgaaagtcctggtcaatgacgatgtcgccgtcaccgacagcctgtacacggccggccggcgcggcacgggcgcgaccttgttcgtcgagaagatcgcgggcgccgccgccgaggagggcgcgccccttcagcgggtcgaggcactggcccggcaggtcaacgagaacgcgcgcagcttcggtgtcgccctgagcgcctgcaccaccccggccaagggcagccccaccttcgacctcccggacggcgagctggagctgggtgtcggcatccacggcgagccgggccgggagcggcgcgcgatgatgacctcgcgggagatcgccgacttctcggtgcacgcgatcctggaggaccttaatccgagcaaccccgtgctggtcctggtcaacggtatgggagcgaccccactcctggagctgtacggcttcaacgcggaggtgcagcgggtgctggtggagcgcggtgtcccggtggcacgcacgctcgtcggcaactacgtcacctcgctcgacatggccggcgcctccgtcaccctgtgccaggtcgacgaggagctgctgcgtctgtgggacgcgccggtgagcacgcccggcctccgctggggcatgtgatccactcgacgtccggtcaacgtacgtaccacgcaaggagattccgtgctcgatgccgacttcttccgccgttggatgacggcgaccgccgcgtccgtcgaccgcgaggccgagcggctcaccgccctcgactcgccgatcggcgacgccgaccacggcagcaatctccagcgggggttccacgccgtggcggtcacgctggagaaggaggcgccggacacgcccggcgccgtcctcgtgctcgccgggcggcagctcatctcgacggtgggcggcgcctccgggccgctgtacggcacgctgctgcgccgcaccggcaaggagctcggggacacggccgaggtcaccgaggaacagctgacggacgcgctgcgcgcgggcgtggacgcggtgatgcagctcggcggagccgcgcccggcgacaagaccatgatcgacgcgttggttcccgcggtcgacgcgctcagtgactcgttcgccgccggccgggccgcggccgaggagggcgccgtcgcgacgacgcccttgcaggcccgcaagggccgggcgagctatctgggcgagcggagcatcgggcaccaggatcccggtgccacctcctcggcgctcctgatcgccgcgctcgaggaggcctccgttgagtgacaccacggacaagctcgtcggcatcgtgctggtctcgcacagcgcggacgtcgccacctcggtcgccgaactggccaaggggctggccgggggcggcacgaccgcgccggtggggcccgcgggcggcatcccgggcggcggcctcggcaccagcgccgagctgatctcggccgcggccgcctccgtggaccagggcgccggggtggccgtgctcatggacctgggcagcgcgatcctcaccgtgaaggccctgctcgcggaaggcgacgagctgccggagaacacccggctggtcgacgcccccttcgtcgagggcgcggtcgccgcggtcgtcaccgcctcggcgggcggtgacctggcggcggtggaggcggccgccacggaggcgtactcctatcgcaaggaatgagaacggcgaggaacggccaccgcgaggaatgacgaccgcgaggaacggccaccgtaaggagtgaccgtaaggagtgactgccgcaggaagtgagccgcaggccggtccgcccggtccgctccgtccgcccgtctcggcgggcaggggccgggccctgcggccgccgccccgcggtcagttctggcggaggaactcgcgggccagcgcctctccttgggccacggcctcgacgtggttctcgatgggcgacacggcggagttcttgaagacgatgtacgtcaccccggagtcggtgccgccgccacgtgggtcggggcggatgccgagggcctgggcggtggcgtacgaggcctcgccgatgatgtcgtgcggtccggtgtcgccgacgaccgtgtactggacccggtcctggtagatcacggcggcgaccgaaccaccccggacgccatgctcgcggtggtcccagatatcgcccgcggtgggcacgacgatgtacggcagggtctcggcattcagctgacggccgtcggactgctgaaacgcggtggcgtcggagaacgacgggtcggtgctctcgttgcacagcaggccgggccgcccgtcgcagtcgatgtccatgtcggccttccagaacacggcgtcgcgccggccgcagacgggaatgtcggccggcgcgccgtcgtcgctgcggtagcgcccgttcgagacgggagcgcagtcgcgtacctttgcgagcagatcggcggcgaggacggtgccctcacgcgctgccgccgccggttcacgggtcccggcggcttcacgtgtccgggcggcttcgtgggtccgggccacttcgtgggtccggacgacgggtggcgacgtcgtgggggcgaccagggcggcactggccgcgaccagcgtcagcgactggacacgcacgatgagggaccctctcgtgggggacattgacggtcacccaccccaaggtggtgcgggtcccgggccacggccaccgggaggggtccggacggtgcacggcgcccttaccacgcgccgtgcggccgagggccgggtccccagggaccccggccacccgaccgctttcgccggcgcgggatcagcgacgacagcggtccgcgccgcgggcacgaactcccatggaagacaggtgagttcacaccgcgtcagccctcagcatacgtagccgcgcgccgtcccggccaacgccgtccgccctcttgatgcgagcgcgccgccatggcatacaggtacagaccaatcccgtcgagggaagggggacccgtgcgccgactggtgcgacgccttcgtgtgccggtgatctgcggctcgctgttcctgacggtgtcctgcgggtggggcggacaggacggcggccgggacgggccgctgccctcggccccgatgggcgtcacggccgcggccggcagcgcgaccagcgtgcacgtcatgtggaaccaggtgtccgggggcccgaaggtcgccgggtacgaggtatatcgcggcaccacgaaggtgaaggacgtaccgggtgcggagcacatggtggacatcaccaggctcaagccctcgacgacgtacgtcttcaccgtccgggcacgggacgatgcggggaacgccgggctgccgagcgcgaaggtgcgcgccaccacgcccgcggccgtcgccgccgatcaccgggcccccacccggccgggacggcccagcggcaaggcggtcgggagccgggcggcccagctgaactgggcgcgctcgacggacgaccggggggtggcctcgtacgacatctaccagggcacctcgaagatccacagcgtcggcggcgggcagacggcgaccgtcgtgacggggctgcggccgggcacccgctactccttcaccgtccgggcccgcgacgccgccgacaacgtctcggccgcgagcgcctccgtacggctgaccaccgccggcggggcggacgacggacggggcaccgcgcccacccgattccgcgccgggacccaccgcgccgacggggcgtactacatcgacctgtcctggtcgccgccggacacggacggagtgatcaccgagtaccagatccacctcgacggccgtccggcgacctcgctcgtgtggggcggcaagccgccacgcggcaaggccacgtacagcttctacctgggacgggacgccggcgccagacaccgggtgcggatccgggcgaagctgccggacggcacgtggggcggcttctccgacgagcggaccgtgaccacggggggacgctaggccgtcgcggccgagggcggcggggcagcggacgatcggacgacagagcatcagctgtccgccggacgatggaatcgttcacctgcccgggggccgtccgcatgcgggccgtcccaggggcgcgttggctcttcctgaggcagcacgggcgattcccgaccccaggcggcgcaagggatgtaccgccaaccgtgccgctggagggcagtcctatgcgcactattcagctgttcagccgttccggcctggccgtggcggccgccgcgcttcctctcaccctcgcctcccccgcggccgccgcctggaattcagggatctcggtgagcaccagcggaagcaacgtttcggtcgccaccaccacgtgcaccccgttcaacggcagcctgggcaacgcctcgctgctctccagcggccaggcgaacttcacccaggggcgcctggcgatgctgaccgggtcgaacatcagccagtccggcgtctggtccaacgtgagtccgggcacgtacacggtcgtggtggtctgcgcgaacggttcgacggccggcacccagtccatcatcgtctccggcagctcgacgcccaccatctccgcgacggcctcgccctcgcgcggggtcatgggcggtgtcggcgggtccgtcgagcactacggcaccatcaccttcgcggtgggcgcggccctggtggccgtcggcgccgtggcgacgggctggtatctgcgccgccgcaccaagccgtaccggctctgaacgcgccggctctggacgcgtcggctctggacgcgtcggctctgaacgcgtcggcggtgagcgcgccggccacctactcgtgcgcgggcaactcctcgaactccgccagcgcatgggtcagccactgcgtccagaacgtctccaggtcgatgccggcgcgcagcacgagatgcctcagccggtcctgcggcgtgtccttgccgggcccgaagtcgcggtcctggatctcctcgtactccgtcaactgccgctggtgcagggctagatgccgacgcaggtcgtcctcgatcccctcggtgccgaccaccgccgaggcgcgcagccgcagcaatagcgtgtcgcgcaggggcttgggttcctgggcggcggcggtccagcgggcgagttcggcgcgaccggcgggcagcacctcgtacgccttcttctgcccgcgggccggctgctgcgtgggcagcgcgcggatgtagccctcggcctccagttttcccagctcgcgatagatctgctgatgcgtcgccgaccagaagtaaccgatcgacttgtcgaagcggcgggtcagctcgagccccgacgacggcttctctagcagggcggtgaggatcgcgtgcgggagtgacatgggctcatcctagggacggtgccgcgggggtccccgcggctgctacagcgcggccgccagctccgtgccctgcttgatggcgcgcttggcgtccagttcggcggccacgtccgcgccgccgatgaggtgcgcgcggtggcccgcggcgatcagttcctggtacaggtcgcggcgcggatcctgcccggtgcacaggacgacggtgtcgacctccaggacctggctgtgcccgtcgacggtgatgtgcagcccggcgtcgtcgatccggtcgtactggacgcccgggaccatggtgacgccacggtgcttgagctcggtgcggtggatccagcccgtggtcttgccgagtccggcgccgaccttggaggtcttgcgctggaggaggtggaccgtgcgcggcggggcgggccgctcgggtgcgccgaggccgccgggtgcgcggtagtccatgtcgacgccccagctgcggaagtacgtcgccgggtcctcgctcgccttgtcgccgctgtcggtgaggtactcggcgacgtcgaagccgatgccgccggcgccgaggaccgcgacgcggtcgcccaccggggcgccgtcgcgcaggacgtcgaggtagccgagcacgctcgggtggtcgatgcccgggatctcgggggtgcgcgggctgacgccggtggcgaccacgacctcctcgtacgccgcgacctgctcggaggtgacgcgggtgttcaaccgcacgtcgacgccgtgctgttcgagctgggtacggaagtagcggagtgtctcgtcgaactcctgcttgccggggaccttgcgggcgacgttgagctggccgccgatctcgctcgcggcgtcgaagagcgtgacgtcgtgcccgcgttcggccgcgctgaccgcgcaggccagcccggccggaccggcgcccaccacggcgacccgcttgcgcagccgggtcggggacaggatcagctcggtctcgtggcaggcgcgcgggttgaccaggcaggaggtgatcttcccgccgaaggtgtggtcgaggcaggcctggttgcagccgatgcaggtgttgatggcctccgggcgtccggccacggccttggcgacgaagtcggggtcggcgagcatcgggcgggccatcgagaccatgtccgcgtgcccctcggcgagcaactgctcagccaactcgggggtgttgatgcggttggtggtgacgagggggacggagacggcacccatgaccttcttggtcacccaggcgtacgcgccgcgcggcacggaggtcgcgatggtggggatccgggcctcgtgccagccgatgccggtgttgatgatggtcgctccggccgcctcgacggcctgggcgagggtgatgacctcgtccagggacgatccgccgggaaccaggtcgagcatcgacagccggtagatgatgatgaagtcctcgccgaccgcctcgcggacgcggcggacgatctcgacggggaagcgcatgcggttctcgtacgagccgccccagcggtcctcgcgccggttggtctgggtggcgatgaactcgttgatgaggtagccctcggagcccatgatctcgacgccgtcgtacccggcctgccgcgccagacgggcggtgcgcgcgtagtcgtcgatggtccgctcgatctcggcgtccgtcagcgcgtgcggcgggaaggggctgatcggcgcctggagggcgctgggcgcgacgaggtcctggtgataggcgtagcgcccgaagtggaggatctgcatcgcgatcttcccgccctcgcggtgcacggcctccgtgatggcggtgtgctgctcggcctccgcctcggtggtgagcttggcgccgccctcgtaggggcgtcccgcgtcgttgggcgcgatgcctccggtgacgatcaggcccactcccccgcgcgcccgggccgcgtagaactccgccatgcgctcgaagccgcgctcggcctcctccaggcccacgtgcatggagcccatgaggacgcggttgggcaggctggtgaagcccaggtcgagcgggttcagcaggtgcgggtaacggctcatcgggggtcctccgtgcgcggtgtcgtgcgtctgttgtagacgacggcgcaggctttatgcaactagttgcacaatcagcggaggcacgagtgggcacggtcacagggcaggggcggccacggcggcgacggtcccggggccggccgccggccccggcatcggctcgctcgaccgcctccgcggggcggacgtcccgcgcggggcgaccgccgacggccgggcgacgaccgtcgaaggcaccgcgcaccagaccggcacggtgcggcccgatgccttcgacgcgatcccgcgcgactccctacgccccctggggctccgacgcccgcccaggtctggtgccgatcacgacgttggcgcagagctcctccgagacggcgagccgggcgtccaggccgccgcgggtgaacgtctcgacggccagggacgcttggcgctcactcgtctcgacgagcagcgagccgccgggggacagccaccgggaggcctcggcggtgacccggcgcaggatgtcgaggccgtccgagccgccgtccagggcgaccaggggttcgtggtcgcgggcctccggcggcaggaggccgacctcatcggtgggcacgtacggcacgttggcggccaggatgtccacgcggccgcgcaggtggccggggagggcggtgaacaggtcgccctcgtggacgtgaccgccgcaggcggcgaggttgcggcgggcgcagcgcacggccgccgggtcgatgtcggcggcgtgcagttcggggccgtcgagcgacgcggccagtgcggcggcgacggcacccgagccgcagcacaggtccacgacgacggacacctcacgcgcgagggagaccgccagatcgacgaggaactcggtacggcggcggggcacgaagacgccgggatccacggtgatgcgcaggccgtggaacccggcccagcccaggacgtgttcgagcggcagacccgcggcgcgccgctcgaccatcgtggcgatctcgccgggcgtgcgggcggtggagaggatcagctccgcctcgtcctcggcgaagacacagccggccgaacggagcgcggccacgacggcggaagcggaagaagaagcggaagaaagtggtggcatggaagccgagagcctttcggtgagccgaagggcgccctcgcgatcgcctaggggcggcgatccgcactgctcggagaggagagcacccgacctgacacagcggtaatgggtctcacctcctcgacatccgcccggccggggcgatccacagccgggacgacgaccctagcaggagcggtcagacaccgacggactcctccaactcctcctcggcgtcggccggctcctccccggccgccttctccgccgacgtcacgcccaccggcttcgcgtgcgtgcgccggggtgcggccgcacgggcccgtacgcgctccaccgcgccggccacggcggtgagcaccagaccggccagcagccagaccaccagcctccacacgtcgcccgacaggccgtcccggccgaagtacaggaggctgcggacgccttccacgaatccggcgccgttccagaaggcgtgcagggtgccgaagaagccgttctgcagctcggggcggaacaggccgccggagctggtgaagttgagcatcacgaagagcaccatcatggcgagggtggtccagcgcttgaggaacgtgtggaggcccacgccgatgaagaggatgcccgccgagtagagccagctcatcccccacaccgtcagcaggtcgtggtgcgcgaggtggaacacgggtccggccagcagcgcaccgatgacgctcaccacgccggagactccggcggccagcagcgcccgggccctcatgggcagcgtggagcccgcggcgccgagcgcggcgaccgaggcgtacgagccgatgctcaccgcgatgagcaggaagaacagtccctggcccgtggggtcgtcggcggccggcggcgccacgtcggtgaccttgagcgggacgtcccgctgggcggcgacgggcgtgaagaccttctcgacggcggtggcacccatgtcggacgcggccgtggcgacgaccagttcgggcgtcttcgcgctcggcacataggcgcccgtgatgtcacgggacttcagcaggtcgaccgcctcggcacggctcgcgacggtccgtacgtcgagcttgtccccggcctcgtccttgaccgtctgggcgaagaccttcgcctccggggcggccccgacgacggcgacgggcagatggttcggctccggtgtcacgaacgcgcccatgtaggccagccccatgccgagacacatcagcaggggggtgaccaggtgcgtgagcacatgacgcagcgccggcgaccgcagcccggtgtccatgtgaaccctcctaaaggttggcttatacaactctcactcaagttgtactatacaactaggagacggaaggaggggccgtgaagacagtcgaagggcccgatgagaccgttgtcaccgtcgaggaacccggcgcgcacggcgcgcacggcgggtcggacgcggaggcggccgtcgagaccatccagcgcgagatgacggccttcgcccgccgtgcccgggcctcggcgggccggatgcaccccgagttgtcgctggtgtcgtacaccctgctcgggcacctggaggagagcggcggctgccgcgccacggacctcgccacgcactacacactcgacaagtccacggtgagccgtcaggtggcggcactggagcgcacggggctcatcgagcggcggctcgatcccgaggaccaccgggtacaggtgctgcatctgacacaggcgggccgaaggatcctggcccaggtcaccgagagccgccgggaggcgttccacgagcgcctcgccgactggccgaaggaggatctggagcgtttcgcggcctatctgctgcgctacaacgcggcggcgggcgagggcccgctcaaggagaggtcggcggacggctgacccgtaccccctcgagcggccctcgtggactccgcctgctcagacacccacttggcggccggccggcacgtgctcgggcacccgggccgcgaggaacctggtcgtgcggcgcagccggaagcccagggcctcgtagaggcggatggcgttggtgttgcccgcgccggtgtgcaggaacggggtctcgccgcgttcgcggatgccgtgggcgacggccaggaccaatcggccggccaggccctcgccgcggaactccgggtcggtgcagaccgcgctgatctcggtccagcccggcggatgcagccgctcccccgccatcgcgacgagggcgccgccccggcggatcccgagataggtgccgagttccacggtgcgtggcaggaaggggccgggcctggtgcgctcgaccaggtccagcatctcgggcacgtcctcggggccgaggcgtaccgcctccgcgtccggggccgccgcgatcccgttgtcgacgagctggacgcccgcgatgtcgaaggtcacctcccagccgtccggggcccggccgcggaacccggcgaggggcgcctcttcaccgggcccgaccagcgcggcgagatcggcccagtcgtcggcatcgggctcgtcgggcaggcccagccacggcgagacgtcgacggggtagcgcaggacacggccccggcgttcggcgaagtgggcgtgcgggccggtgagcgaggcgagcgcggggttgtcgaggacgtggcgctccgggcgcgggccggcgatgtcccgtgcgggacgcgctgcggtctcgccgctcacgtcgagggcgcgacggtcgtcgctctgccccctcacatccagcacatggccctcggcgctccgcccgcgcacctgcgggacgcggtccccggcgctccgtccggcctcctccggcgcgcggccgtcggtgtcctgtgcgctcattcggcgacctcgatcacgaccttgccgcgggcgtggccttcctcgaccgtgcgcagggcctcggcggccagttcgagcgggaatgtccgcgtcacgtacggcttcagctcaccgccgacggcgagcgcggccacggcgtccagcacggccgcggtgcgggcccgtgccaccggcgcgccgcccagccgcgcgacggtctcccggtcggcgccggtgatcagcttcgtgcggtcggtgagcagcgtggccgcggcctccaggacctcgccgccgacgaggtcgaacacagcgtccacgtcgcccggagccgccgcgcgcacccgctcggccagctcgggaccggagggcacgtgcacggcgctgagcgattcgacgaggtccttcttggcctcgctcgcgacccccacgacccgcagtcccgcggcccgagcgagctggacggccgcgacacccacgcccccgcccgcgccggtgatcagcagcgtcgcaccggagggcaggccgagctggcggacgccgtcgtacgcggtcgccgccgcgacgggcagggtcgcggcgtccgtgaaggacagcccggcgggtttgtgcgcggtcgtcgtcaccggcagcaccgcgtactgggcgtatccgccggccaccgggttgccgaagacctcgtcgccgacggcgaagccggtcacgccctcgccggtctcctcgacgacgccggatacctcgttgccgaagacggcgggcagttcgcgggccgggccgccggggcgccggtaaccggtgcgctgcttccagtcgaccgggttcacgcccgccgcgcgcaccgcgacgacgagctgtcccgggccggcgctcggccggtccagatcgacgagcgcctcggtctccgggccgccgtaccgcgtgaacacgtacgccttgggcatctgctccctcactctccttcgctgtcaccgagtgaccggctgccagggccaccggcgtcggcactcaacggcaagggagatcgctggacggctattcccgggccgccgaagagttcatacggccgcaacgatcggccgtccgacaagggcgggggcgccgtcgccgaccgcgtacggttgaatgcgtaagtactgatcacgtccggccggcgggccgccgctcggacggcctggaggcaccacccgcaatgaacgtcacccgaggcttcacggggcgcccgcgcgtccatcatcccggactgccgcccggccagtacgacgcgggcgacgactggcccgtcctgtccgccgaggtcacgccggacctggcggcggccgactggtccttccggatcgacggtctggtggccgagccgcgcacctggagctgggacgcggcgcacgcgctggcgccgtccgcctacgagggcgacatccactgcgtgaccagctggtcgaagttcggggtgcgcttcgggggtgtgtcgctggacgcgttcctgggtctcgtacgcccggacgcgaccgccacccacgccgtcgcctactcgcacaccgggtacaccacgaacctgccgctgacggatctcaccggggggcgcgcctggatcgcgtgggagtacgacggcaggccgctgcccgccgagcacggcggcccggcgcggctgctcgtgccgcatctgtacttctggaagagcgccaagtggatcgcgggcctcaggatcctcgaccacgacgagccgggcttctgggagcagaacggctatcacgcccgcggcaacccctgggaagagcagcgttactccggtgactgagaccttcgtacccccgacccggttcgccgtgcccggccggatcgccgtgagcaaccgggcagcggccgtctggcagaccgccacgctcaccgagatccgccgtgagacgccgcacgccgccaccttccggttcgcggtgcccggctggcagggccatctgcccggccagcacctgatgctgcggctgacggccgaggacggctacggggcgcagcggcactactcgatcgcgtcgccgcccgaggacgccgggcacatcgagctgacgctggaccatgtcgagggcggcgaggtctccggctggttccacacggtggccgagcccggtgacgaggtgcaggtgcgcggtccgctcagcggcttcttcgcgtggcccggcgaccggcccgcgctgctgatcggcgcgggctccggtgtcgtaccgctgatgtcgatggtgcgccatcaccgggcgcaggggtcgacggtgccgttgcggctgctcgtctcggcgcgcagcccgcaggagctgatctacgcccgcgagtacggcgacgagaccacgcccgtcttcacccgcgacgccgcggcgggggtgcccgtgggccgtatgtcggccgcccatgtggcgccgctcctggaccgggcgcctcctggtgggtgggaggcctatgtgtgcggctccaacgggttcgcggagcatgcctcgcggctgctcgtcgaggccggtcagccggtgcaccgtatccggatcgagcgcttcggctgacctcccgcgtggggccgtcagcagtgcgggaccacggccaccggacagcctgcgtggtggatcagggagcgggcggcccggcccaggcccggtgccgacgtacggcggccgatcaccaggagcccggcccggatggacgccctgagcaggtggtgtccgggatgaccggggatcacccgctccaggacgtcggtccccggaaacttgtgccgccagggttgcagcgtcgtcgtcagcgtccgccgcgcgccctcctcccgctcggccgcgtcgccgggcagcggcgctccgggcgcgtgtcccgtcggcgggagtgtcgtccaggtgtgcaccacgtgcagcggcgccgagcgcacggccgccgcctcgaaggcgtaggcgatcagccggtcggccgggtggtccaggtcgaggccgaggacgaccggcagatacgcggcccggccgggcggtgtgccgtcgtcggccggcatccgctcgtcctcggccagttcgcccgtgcgcacgagcacgaccgggcgcgcggcgcgggccgcgacggcgagggccaccgagcccacgaggaatcccgcgaatccggtgaatccccgggagccgaggacgagcgtctccgcctccgctgccgccgccagcagcgccgggaccgcgggtgtctcggtacggcgggcgatgatgtccaacgccgggtgcgcgtaagccagttggaccgcggcccggtcgagggcggtgcgcgcgggcaggtcgacgtccggcacgggggcggggacgggcggttcggcgcccgcgtgcagcaggcgcagcgggagtcggcggcgttcggcctcgcgtgcggcccagtcggcggcgtcgaggccggtgcgcgatccgtcgatgccgacggtgatggtgcgggtgccggaggtcatggctcctgcctttcggatttcgacgatcgaccgttccgggaggcgtgcacgcggggtgcgcgaggcgtgcgcgcggggtgctgcttgtggtgacggctgaggcgcgtggggatgttgtggcggcggggagggcgcaccggggtgttcccggcggcggtgggggcacccggggtgctgggcatccttcgccatgcgggctccttctcctcacgcgaccgatgcgcgggttccacggggtgcgcggatcagtcgtacaggcggacaatcagcaccaggccccttgtgggcgctgccgtcgggcgcaccgcgccgggagaggtgtacctgccgggccaggttccgttcggccccttcccgggccgggcggaggcggcgaggaggtcggacatgcgaacccggatgcggtaccggtatgaacgtcgtaatccgctgcggcgccgctcggacgtcgtcgaggcgtggacggccctggtcgtcgccgtgctgctgttcgtcgccgcgccgctcgccggtgcggccgtgggctggtgggcgtacgacagctcgcactcgctcgccacggcccagcgggccgagcggcggcatgtctccgcgaccctcgtcgagaacgctcccgccgcggtcccgtccgtccaggacagcaaggagccgctgtaccaggtgaaggtgcgctggaccgagccgggccggggcgcgcgcaccggaccggccatggtcccggcgggctccctgcgcggcgaacggaccgatgtgtggctggacggccggggcaggagcgtcgcgccgccggtgaccgacaccctggtctggcagcacgcggtgacgtcgggcgtgtggaccacgggcggcgtcgtgggcctggtcctgctcgcccggatcgccgagcgccggatcgccgaacggcaccgcatggccgagtgggaggaggaatgggcgcgtacgggcccggagtggaggaagcggaccgcgtgacggcgcccgggtacgcccggggcgccccggtcagcgcccggtagcagggctccgggagtctcccgcctgtctcgggccgggttcccgcgacgtcggcagccgcgacccggcccgcaccgatcgccggccaaccgccggagatctcgcgctccccgtccgcgacgagcggccggaggtccttcccgaccagatccggacggccgtgccggagccggtcaccgtcctgtcctggcaaggcctggcggccccctcggcagcccccgtacggtgtgatcatccgcgctcatggccagacactcatgacatcaaaggtggtccctcatggccctgttcgacctgcctctcgaccagctccgcggttatcgcagcgcgtcggccgagcccgaggacttcgacgccttctgggccaagacgctccaggaggcccgccagtacgacctcggtccccgtttcgagccggtcgagacgcacctcgagacggtcgaggtgtacgacgtcacgttcgccgggttcgacggtcacccggtgaagggctggctgacgctgcccgcccgggcgaacgcgccgctgccgacggtcgtggagttcatcgggtacggcggcggacgcggccttccgcacacgcatctgctgtgggcctcggccggcttcgcgcacttcgtgatggacacacggggccagggcagcgcgtggggcggcggtgacactcccgacccggtgggcagcgggcccgctttccccggattcatgacccggggggtggaggaccccgaaagctactactaccggcggctgttcaccgacggcgtccgtgccgtggaggcggcccgggcccatcccctgaccgactccgcccgcgtcgcggccgtcggcaccagccagggcggcggcatcacgatcgcggtgggcggcctggtccccgacctggccgcggtcgcgccggacgtgccgttcctgtgcgacttcccgcgcgcgacgacgctgacggaccgcgacccgtaccgcgagatcggcaggtacctcaagacgaaccgcggccgcacggagcaggtgcagcgcacgctgtcctacttcgacggcgtgcacttcgccgcccgcgggagcgctcccgcgctcttctccgcggccctcgaggaccagacgtgcccgccgtccaccgtcttcgccgccttcaacgcgtgggcgcacgccgacaaggcgatcgaggtgtacgacttcaacgaccacgagggcggcggcccctatcaggaggcggcacagctgcgctggctgccggaccgtcttcgatgagcatgagccgggcggcgacggccgaggcggcccggcggttcgtggcggtgtgggagcgggcctgggcggcgcacgacgtggacgcgatcgtcggcctgtacgccgaggactgcgtccaccgctcgatgccgttccgcgagccgcaccggggccgcgccgcactcgccgagtacatccgctggtcgttcgcggccgagcggacccaggacgtgcgcttctccgagcccgtcgtcggcgacgacgggctcgcggtcgcggagttccgggtgctggccgaggaggacggcacgccctcgacactcgccggctgcgtcttcgtacgcttcgacgcgagcggcctggccgtggagacccgtgactactggcacaccgtcacaggccacaaggagcccaccggttcgatgttcctgaggtgagttggggctgacgtggggctgacgtcgggccggctcgggccgacttggggcctcggcccggtggtggcgcgacatccgtccgcgtccgacggcttccgtccggtccgaccagtcggtacgttcagcacgcccggtcccacggccgggccacccggacccggacgacggaggacccatgtcccagcaggtgccacaggttcaaggccggtgcgacgagcgcttcacggcggtgcgcgaggcgttcgaggggaacttccgcgagcggggtgagctgggggcggcggtggccgtcacgctcggcggcgagaccgtggtggatctgtggggcggctgggccgacgcggcgcgcacccgcccctgggagcgggagacgctggtcaacgtgtggtcgacgtcgaagggcccgacgtccctctgcgcgcacatcctggccgaccgcgggctgctcgacttcgacgccccggtggccgcgtactggccggagttcgcggcggcgggcaaggagtccgtcctcgtacggcatctgctgtcgcaccgcgcgggcctcgcgggactgcgcgagccgcattccgtcgagcagctgtacgactgggagctgaccgcgcagcggcttgcggcgcaggagccctggtgggagccgggaacgcggtccggttatcacgcgatgacgttcggcttcctcgtcggcgaggtggtgcgacgggtgtcggggctgctgccgggtgccttcctggagcgggaggtgaccgggccgctcgccatcgacttcacgatcgggctgccggagaaggaggcggaccgggccgcggagctggtgcatccgcgggccgcggcgaccagtgaacaggcggcgatcttctcccagttggcgccggtggccctggccgcgctgctcaaccccgtggtcggcgccaccgagggcaacaccgagcagtggcgggccgcggagatcccggcggcgaacggccacggcacggcgcgcgcggtcgccgcgctgtacgggatcttcgccgggcggggctcgtgggacggacggccgatactctcccccgaggccgccgagcgggtgcgcgagggccagggcagctgccgtgacctggtgctgggtgccgggttcgagagtgagacggagatcggcctcggcctctggctcagcgggtccaacggatcgtacggtcccaacccgaaggctttcggtcacgacggcttcggcggctcctgcggtctcgccgacccggaggcgggtgtctcgctggggtacgtgatgaaccgcatgggcccgcacatcgccgacgacccaaggaagatggcgcttgtcgacgccctgtaccgcgcgctctgaggccgtcgcgagcaggccgggcgacgcgggtcggattcggccgaactgcccggccgctcttccctggtggtttagaccaatgctagatctggtcgcgcaaagatcccgcacgactacgtcttgtcaccaggaggcgcggacatggcccgctccaccacatccgaccacgacccgctctactggaggatcgcccacgatctactcggcgaactgcgcgacggaaccattccgccgggggaacgactgcccggcgagcggcacttggccacgcacttcggggtcagccgcgagaccgtgcgacaggccctgcagatgctgcgccgcgacgggctggtcgccacggaccgccggggcagccacgcgacgctgcccggcgccacggccgaacccggcgccgacgccgcccacatgccgtcgctcaccttccccgtgggcgcgcagaccacggagccctgccgggcgaccgtcacctgggaagaaccccccgcggagcacgccctggccctggggctcgctccgcggcggccgacgctcgtacatcgctacgagtcggtcgcggccgacggcagcgggctgcgtacggccctgacgtcgttctccgtcgtcgcggtcacggaggtcgcggagctggcccgctaccgcgaccgcgcggacggctcggcggcggcccagctgtggcgcgcgtacgactggatgcgcaaggcggggctgacgctgcaccaccgtgactcgatcacccagttccccccgtcggtacgggtcacccggcgcgtgcacgaccagcatcaccgtccactggagatcacggaccttgtcgcggatgcccgactggacgccctggtctacgagttcaccctgccggcggccggctgacccctgtgtcgcgcgcgcggtccacggcggggcgaaccggcaccgctggaggtacgcgacgtaagggcacggccggtgctgtgaggggtacggccatgcggggcgccgtaccccttgcccggacggtcaggtgcggccatccggcagattgcgggagcgccgcacccgcatggcgtcacgccccggccgtaccgctctcccgggtggccacgaccatccggcagcgcgggcttccgtcgggccgctgtccgaacccgggcagggcgacgagctccacccggaatccggcgcgcaccagttcccggcgtacgtctccgaggcggaaggcccggtagtacatgacgaacggcggacgccacagggcgttgcgcacccgcatcgccgtgtcgaagcccagcagggcccagtaccagggcgaggcggggcgcggcggggccgcgacggggaacgcgaaccgcccgccgggccgcagcacggagtggacctgagcgaacagaccgggcagctcggccggcaggaagtgcccgaaggcgccgaagctcacgaccaggtcgaacacggggccgaacggcagcgcgcgggcatcaccgcggacccatgtgacgtcgggctggccgacggcccgcgcctgctcccgtcccaccgccagcatccccgcgctgatgtcgaccccggtgacgccttcccggcacaccgtacgcagcacgtcgacgcctgccccggtgccgcagcacaggtcgagcccgcggtcgaacggccccatcggctccaaggcaccctcgaccgcttccaggaccgagtccggggtccggaacggcgtgtggtcgaacttgggtgcgagcaggtcatagccgtgctcgacggacgacagggcctgaacggccagttcgcggagggtgggaccgtgcggtgagaacatcgcgctcagcttaggggcaaacgcgccgcgaagatgctcgccttcggaggcacagataccggaagagatcgccttcggcagcggcgggcgtcgaaaggggtcaccttcggccgaggggcagcgcgcgccgggcgggctcgcctagggtccgcttcatgacttcgttccgtcccgcccccgcatggctggccgacgccgtcttctaccagatctatccgcagtcgttcgccgattccgacggcgacggcatcggcgacttcaacgggatcgtccagcgcctcgaccacctcgtgtggctgggcgtcaccgccgtctggctcaacccgtgcttcgtctccccgttccgcgacgcggggtacgacgtctccgactacctgaacgtcgcgccccgctacggctcggccgacgacctggccgagctggtcgacgaggcgggccgccgaggtatccgcgtccttctcgacctcgtcgccggtcacacctccgacgaacacccgtggttcacggcctcggcgaacgacccggacgaccaccgctacatctgggcgcccgagggccgcccggacggcttcgtcacctcgcccggcacccgtccgggcgcgtatctcccgaacttcttcgacacccagcccgctctcaacttcggctacggtcgcaagaacccggccgagccctggcgacagccggtcgacgccgcgggcccgcgcgccaaccgcgaggcactgcgcacgatcatggaccactggctgggtctgggcctggccggtttccgcgtggacatggcggcatcactcgtcaaggacgaccccggcaggacggagacggccaggatctggacggagctgcggcactggctggacacggctcacccggacgcggtgctgctgtcggagtggggcgagcccgaggtgtccgtcccggccggcttccacacggacttcttcctccagttcggcggcgcgacggacggcctgcccctgcgctcgctgtggagcaacggcgacggcacggtcaacgaggcctgggacccgctggactgcttcttcgacgcgagcggcaagggctcgccgcgccccttcgtcgaggcgtggcgcaaggcctccgacgccgtcggggccaccggcttcgtctccctgcccaccgccaaccacgacttctcccgcctcaactgcggtccgcgcacggccgagcagctccccgcggcgttcgccttccagctgacctggccgacactgccggcgatctactacggcgacgagatcggcatgcgctacgtcgggggcctgcccgacaaggagggcagcgtgctgggcccccgctacaaccgcgcgggctcgcgcaccccgatgcagtgggacgacggtccgggcgcgggcttctccacggccccggccgaccggctctacctgccgctcgacccgtccccggaccgcccgacggtggccgcccagcgcgccgacgacggctcgctcctccatctggtgcgccgcctcgtcgccctgcgcgcgagcacccccgcactcggctcgggcggctcggtggaggtgctgcacacggggtaccccttcgtgtacgtccggggcggccgctatctcgtggtcgtcaacccgcagcgcaacgaggtgcgttgcccctacgacgccacgcgggaggcacgcgcgctggaggcgtccggcgtgcgggtcggcaacggcaccatcgaggctgaagggttctcgtacggcgtcttcgacctgggccggtagatcagctccgggggactcccggccgcaccgggagcgcccgcacgctgttgcccacgaagctggagtggcgcgccagttccgcctcggggacggcgagttcgaggtcggggaagcgggtgaacagccgctccagggcgatggtggcctccatccgggccagcggcgcgccgaggcagtaatgggcgccgtgcccgagcgacaggtggcgcgtggtctcggacctggcgggccgggtgacgtcgaaccggtcggcgtccggcccgtgtgcggccgggtcgcgtccggcggccgagtagccggccaggacgggggtgcccgcggggatgacggtgccgtcgaccgtcagatcgcgcaccgggtagcggaacgggaagtagctgacgggggcgtcccagcgcagggtctcctcgacgacgtccggccagccggcgtctcctttgcgcaccagctccagctggtcgcggttgccgcacagcgcgcgtacggcgttggtgatgaggttcagcgtggtctcgtgcccggcgatgatcatcaggaccagggtgccgatgagttcctgctggctgagccggtcgccgccctcgtcccgggcggcgatcagcgcactggtgaggtcgtcgcccgggcgctcggcccgggcggcggccaccgtgctcaggacggccaccagctcccggttggcggcgatggcctgctcgggcccgatgtccgtggccaccacctggttcgacaggtggtgcagtcggtcccggtgctcggcgtcgacgccgagcagttcaccgatcacacccatgggcaggggcagcgcgaagtgcgctcgtagatcggcgacctggccgccctcctcggccgcgcgcccgagaccgtcgagcagcgcggacgtcaactcctctatccacggtcgcagtcgctccacccggcgggcggtgaaggccttgctcaccagcgatctgagccgccggtggtcctcaccgtcggcggttgtcatcccctgcacggtggcgaaggtcagcagcggccaccccggcgcggtccgcccctcttgcagcgcggtgaagtgccgtgcgttcttggccacttcggggtgcgcgaggaactccttgagcgcgtcgtgcccgaggaccgccatgccttcgatgtcaccgggcaggagaaccggcgcgacggcgccccgcgcgagcagccgcgcgttgtcggcgtgcggacagccgccggccgggtccatgcggtgcggctgcgtgccggacgaggtgtccaacgaggtctcctgactgcggcgtcgggtcggggccgtacgacggacgagtctgcctgctcgcggtaccccgcgcacacgcccccggcgctcccttcaggccatcacaggaagggagtacccgggtccatgccggacagcacgcggccgtagatctccatgttggtggtggggttgacgaaggagtgcagacacagcgcgtggatgtcgcgggtgatgcgttgcatgggcacctcctggtgaagggaggaggctccgctcgcggcggcgagcaggtcgacggcctcccggcagatccgggtcacataaccgctctcggcccggatgcgcgcccgctccagcggggtgtacgggaggtcgtcgcgggccttggcctcgatctcggcggtcagccgggccaggtgcagctcggcaccgccgaccctcatctcggcctcggccacctggagatgggtgaccgtggcttcgttctgccgctcgtggaaggtgtacgtgatgccgcgccggtggatgcgctcggtgaactccgccaccgccgcccgggccaggccaagggccaccggggccgaccaggcgcagaacagcagcagtaccggcatacggtagaaggggtcgtccgcgttggccttcgacgggaaccgcccggcgagcatcggcccgaccgcgagcatgcggtgcgcgggaacgaagacgtcacgggccacgaccgtgttgctcccgctgccggccagccccgtgacgtgccagtcgtccagtatctccagctcggccatggggacggcggcccacctgatctccggcggccccggcgggagctgtccgtcggcggcggccaccgcggtcgtcagcaggtgccagtccgcgtgatggcagccggtggcgaaggcggaggtgccgctgacgcggtagccgccgccgtacggcaccgccgtggcaccggggatcagcgtcccgccgatcctgacgtccgggccgccggggccggtgaagaactcgtcctgcgcctcgtcggggaagagcgccgcgatgtacgagacgcccgcctgactcagcgtcatccacgcggtggaagcgcactcggcggcgatctcggcgaaagcgtcgacctgggtccgcagcggagtctggtgaccgccgtagcggcgcggcacgttcatacggtggatcccggtgccggtcagcgcctcgacgacctcgtccggcacccgccgctcacgctcggcgcgcagcgcgttctcccggatcagcggtcgcagtgctcgtacgcgttcgacgatcccggcatcgaccatgccgaccaccgtcgcgcgccccgcctcccctgtcaacgctgccgcgaccggccgcgtgggcgggaatgagatggctctcggccgtgttgcaggactggatcgcgtatccagtggtacgctgccgatggcacttgtgtaacgccccttctttcggcgccggtgcccagtccttctccatcagctgtcgcgcccgtccttcacgaccggcgatccagcttctcagcaccacctcctgagcacggccacggacagatcgttccgtccgccgcacccgaggtgtttccgccgcgcacaggcgtgagcacgccgcctccggcctctccccccttcctcaagaccgcatgacctcatgacccagtccgtgaaaggacctctccgatgaccaccacactcgaacaccctcccgtacagcagcagctcccggcccacgccaccggtgtcctcgacatcgcacagggcgggcaggggtacctgcgcaccgggaactgcctgcccactccgaacgacctccaggtccccgccgcgctgatccgccgtcacggcctgcgcaagggcgacgtcgtcgaaggcgtacgcggcggccagcgcggcctcaccgaggtggcgtcggtcaacggccgcgcccccgagcagctgcgcggccgcccccacttccgtgacctcaccccgctgcacccccgcgaacggatccggctcgaacaccccgcgggcgggctgtccacccgggtgatcgacctgatcgccccggtcggcaagggccagcgcgggctcatcgtcgccccgcccaagaccggcaagaccgtgctgctccagcagatcgccgcggccgtcgccgggaaccaccccgagtgccacctgatggtggtgctgctcgacgagcgccccgaggaagtcaccgacatgcggcggtccgtgcgcggcgaggtgtacgcctcgaccttcgaccgggcaccgaagcagcacatcgcgctcgccgaactcgtcgtcgaacgggccaagcggctcgtcgaacagggccaggacgtcgtcatcctcctggactcgctcacccggctgtgccgggcgcacaacaacacggccgccgccggaggccgcacgctcagcggtggtgtcgacgctgccgcgctccagggccccaagcggttcttcggcgcggcgcgcctggccgaggagggcggttcgctcaccatcctcgccacggccctggtggagaccggctcccgcgccgacgacttcttcttcgaggagctcaagagcacgggcaacatggaactccgcctcgaccgcgcaccggccgccaagcggatctacccggccgtcgacatcaccccgtccggcacccgccgcgaggaactcctgctgccttcggccgagttggccgccgtacgaggactgcgccgcgccctgcagacccgggacggccaggccaacctcgaaaccctcctggagcgcctgcgcgccacgccggacaacacggccttcctgcgccaggtccagccgacgctgcccgccgcataggcggcgcttgcggcatccgggtgctcgatccccccgcccggcccaggcatccccgcgtgggcggtctccgttcctacggtgtccggtatgactatcagattctcatcccgcatggttggctcctgctccgccctctgcgtggtcggcgcactcgctctggtgccgggcccggccgtcgcccgcaccggcgtcgaccctgctgccccaaaacccacggcgttgcagccgccgccgctgtaccggtccggcacgcaggtgcggccacgggccggggcacccgaggtcccgaacgtgtcggcgctgtcgtggctggtggccgacgcgggcaccggcgatgtgctcgcctcgcacgacgcgcaccgcccgctgccgcccgccagcaccctcaagacgctcttcgccctcaccatgctccccacgctgcccggcggcatccggcacaccgtcgcggagcgggaactggagggactcggcgacggcagcagcacggtcggcgtcacggaaggacagacgtaccaggtcacggacctgtggcgcggaatcttcctgcactccggcaacgacgccgtgcacgtactggcctcgatgaacggcggctgggacaccacggcccaccagatgcaggccaaggcccgcgccctgggcgccctcgacacccatgtcgtctcccccgacggctacgacgcaccggggcagacgtcgtccgcctacgacctcgcgatcttcggccgggccggtctgaaccgcgaggacttcgcccggtactgctccaccgtcgatgccacgttcccgggcaacggtggggcgtacgagatccagaacaccaaccggctgctgaccggcgccgacgggatcgcgccgtatcccggcctgatcggcgtcaagaacggctacaccagcaacgcgggcaacacactcgtggccgccgcgcgccggggcggccgcacgctcgtcgtcacggtgctgaaccctcagtcgggcggcggcttggccgtgtacgaggaggctcgctcactgctcgactgggggttcggcgccgccgggcgcgtcgaccccgtcgggtcgctgctctccgcgcgcaccgtggcgcaggcgggccccgccacgccggatgccgtcatggcgcaggacggtggcggtcccggctggccggtgacgggagcgatcgcgggtgcggccgccgtgggcgcgggggccgtggtgctggcgctgcgcttcaagggcgggcggtccgggcggcgctgaccgaccggcagccgcagcagcagtccgagagtgacccacacataggtgttgctgccgaggaacccgtcgacgccggacgcgtcgtcgaaccacagccagacgacgctgctgcacagcaccacgtacagagtgccggcgacccgcggcaggcgtcggcgccacaggacggcgaaggacgggagcagccagaccagatggtgcacccaggtgatcgggctgaccaggcaggcggccaggccggtgagggcgaaggcggcccgccagtcgcccgcccgcagggcgcggtgggtgcgccgggcccagacggccaggaccagcacgaccgccaccgcccagaccgcacggctcggttcgcccggtgccgcgagccgtgccaggacgccttgcagcgactggttggagacatagtcgaggcggccgacgcgggcggtgtcccacaccgcccgggtccagtagaagcgggaggcgtccggcgccgcccacgccgcgagcgcggtggcggccccggcgaccgccgtcgcgacggccgcggcccgccagcggcgggcgagcagcagcagaccgatgaagagcgcgggcgtcagtttgacggccgtcgcgaggccgatgccgacgcccgcccggcgcccgcgcccggtggacagcagccaggcgtcgccgagcacgagggccagcagcagaaggttgacctggccgaagctgacggtgtcgcggaccggttcgagcagcgccagcgcacagccggccagggcccagccgaaccagccgtggcgccgcagagcgggcccggtgaggatcagcagcaccgcggccgtcgccgcgaggttgagcagcagcgcgagcgcgaccgccgtcggcaggccgaccagggccatcggcagcatgccgagggccgcgaacggcggataggtgaatccgtacgtcgtccccggcacccggtagtcgtagatacggccgccgtggtgcacccacgcgtcgacggtcccgtagtagacgcgcaggtcgaaccagtcgcgcagcagcggcacggtggcggtgaagacggcgacggcggtggcgaggggcagcacgagggcgagccgcccccggtcggtgtgcggcagtctcacgcggtccgccccggcaccggtgcccgcgccgtctgatgagcctgccagagcacgaccagggcgagcacaccaccggagacggccaggaccacctgcgcggtgtccggcggtccgccgttgggcagcaccgcgagcgcgagcacgcagccgacagcggcggcgacacggtggcgcagggaaccgctgggggcggccgccgcgatgaggaacaggccccacagcgcgtaccagggccggatcgcggggccgaggacggccaccacggccaggctcagcccgagcgcgtagaccgggccgggccgcagccgcagccagatgaacaggacggcggccgtggtcgccacgagtccggccgcctgccaggccggcagggcgaggggcgcgagatcgctgccgaggttctccagcagggcgccggtggcacggccgaggacgctggtgggcgaccagttgtggggcgagacaggggtcttgagggcggcgatccagccgtatcccgtaccggcgacggcggtggccagggcggtcgtggcgagcgcgccggccgtggtcgtcgccaccgcccgcgccacaccgacgtgtcggcgcaatgccaccacggcgaccaggccgagcaccgccggcgccttgaccagcgcggccagcgtcacgaggacgacgcccaggacgtgccaccggccgcgcgcggccaccagtccggcgccgagcagccccagcatgacggcgtcgttgtgcgcccccgcgaccagatgcagcagcaccagcgggtggagagcgccgagccacagcgcggcggccgggtcgacgccgctgtgccgggcgagccggggcagtgccgccgccatcagcgccaccccgagcagtgcgaccagccgcatgccgagcagcccggccggcagctcgccgcgcgtcaggccggacagggccgaggcgacggcgaggaagaccggtccgtacggggtcggcgtgtgctgccagaccggggccacctggtccgcgagcggcccgccgagccgcgcggggccgtacgcgtacacgtcgatgtgggcgtcgaccatggcgccctgggcgaggtagctgtagacgtcgcggctgaacaggggcggtgccagcaggagcggcgccgcccaggcggcgagcacccccaggagcgagcgcacggtgggcggttcggggcctcgtacgactgtgcccagcagcgcccacgcggcgatcagcagaacgacgccgaagtacacgccgaccagtccgagcgccgcgcgcccggactcgggggcgatcagctcgcgggccggcagggccccggccgtctcaccgcccgccgcgaggaaggcggtgccggccaggccgagggcctgacagcggcggagatcgacggggaaagccatggccaacactcgggaagcgtgtcaacgccggatggccggaaggcgacgcacttccctccgggcggcggcctgcgtgtgaccgccgtgtgcgcggggccgggccgatgggttcggaccctcagaacgccggtgagttcggaccctcagaacaccgacacgcccgtcagggtcgtgaagcggtcgagggccgcgacgcccgccaccgagttgccgcgctcgtcgaggcccgggctccacacgcacagcgtgcagcggccggggacgaccgcgatgatgccgccgccgacgccgctcttgccgggcaggcccacgcggtaggcgaagtcgcccgccgcgtcgtacgtgccgcaggtcagcatgaccgcgttgacctgcttggcctggctctgggtgagcagccgggagccgtcggcgcggatgccgtgccgggccaggaagccggtggcgagcgccaggtcggcgcaggacgcctcgatggagcactgccggaagtactggtcgaggagcaccggcacggagttgtcgatattgccgtacgacgccatgaagtggccgagcgcggcgttccggtcgccgtgcgcggcctcggaggcggcgacgtcctggtcgaaggtcagccgggggttgccgctctcggcgcgcaggaactccaggagcgacccggccgcgtcgccggtctgtgtctggagccggtcggtgacgacgagggcgcccgcgttgatgaacgggttgcgcgggatgccgctctcgtactccagctggaccagcgagttgaacgggttgccggagggttcgcggcccacgtgctcccacagggcgtcgccctcgcgggccaggtcgagggcgagggtgaacaccttggtgatggactgcgtggagaacggctgccgccagtcccccacgccgtacaccgtgccgtcgagctccgcgacggccatgccgaagcggcgcgggtcgcaggcggccagcgccggaatgtagtcggcgggccggccgcgccccggggtgcgctcgatctcgtcggcgatgcgctccaggaccggctggaaggcgtgggacgaccaggacgcggacatgatcaccattctgccgcccggtcacgcggaacgcgcatccgcctccggcgggcggggccggcgccggtccggcggatcgggccggaggaaggcaacggtgtctgctgaggggcgggcaggtcggaccccgcgcctgcgccatgatccggcgaacaggccctcggccgaccggccgacacccctccccgtggcttccggtgttcgtccactgttcagatctgcggggagccgctgcccgcgagcacctcgggccgcagcagcgacgcgagccggtcggccggcaacaggcccttctccaggacgagttcggcgaccccgcgcccggtggcgagggcctccttggcgatggcggtggccgccgtgtacccgatgtgcgggttgagggcggtcaccaggccgatggagttctccacggcggcgcgcagttcctcggtgttggccgtgatcccgtcgacgcaccgctcggcgagcgtcaggcaggcggcccgcagatgcgtgatgctctcggacagcgagtgcaggatgatcggctcgaaggcgttgagctggagctgccccgcctcggcggccatggtgatcgcgacgtcgttgccgatgacctcgaaggcgacctggttgacgacctcggggatgaccgggttgaccttgccgggcatgatgctcgaaccggcctgtaccggcggcaggttgatctcgttgagccccgcgcgcggcccggacgacagcagccgcaggtcgttgcagctcttggagagcttgacggcgatccgcttgagcacccccgacatctggacgaaggcaccgcagtcctgggtggcctcgaccaggttggcggcggtgaccagcggcagcccggtgagggcggcgagctggcggcgggccgactcggcgtatccggcgggcgcgttgagtccggtgccgatcgccgtggcgcccaggttgatctcgtggatcagttcgacggcctcggcgagccggctgcggtcctcgtcgagcatgacggcgtacgcggagaactcctgccccagcgtcatgggcaccgcgtcctggagctgggtgcggcccatcttcagcacgtcacggaactcgacggccttgcgggcgaaggcgtcctggagcaccgccatggccttgagcagaccgcgcaccgcgaacacggtcgcgatcttcacggcggtcgggtagacgtcgttggtcgactggccgaggttgacgtcctcgttggggtgcaggtgccggtactcgcccttggcgtggccgagcagttcaagggcccggttggcgatgacctcgttggcgttcatgttcgtcgaggtgcccgcgccgccctggatgacgtcgacgacgaactggtcgtgcagcttgccgtcccggatctcccggcaggcggccacgatggccgcggccttcttcggctccagcaggccgagttcctcgttggcgagggcggcggcctccttcacggcggcgagggcgtcgatcagatgcgggtacgtggagatcggcgtccccgtgatggggaagttctccttggcgcgcagggagtggatgccccagtacgcctcggcggggacgtcgcggtctccgagcaggtcgtgttcgctgcggtgggctgcggcggtcatggcagtgcgggtctctttcagagggggacgagtccgacgtacggggtgggtgcgccggacatgtgaggtgcgtacgtcgggtgtgcgggcgtcaggagtacgtgtgccgggtgaggggatcgagagcgcggacgggccggacgccgccgaccggccggccgccgccgagcagcggctcgcccgcgaactcggcgagcgccgccgggtcgacaccggcgcgcgcgagggcggccgcggcgaccgggacacgcgcccggttcgcgccgtcggcgatcttgacggcgacggcgcggccgtccgggagcgcggcgacctgtacgccctcgaagccgtccttggcgagcagtccgggcacggcccgcatcagcgcggcgacgtcgcgtccggtgccggaggccatctcggcgtgctcgcgcatcgcgtcggccacccgcgcctccggggtccccgaaggcgcggtggtgatccgggccgcggctcgcgccaggccgtgcagggagacggagaagaggggggcgccgcagccgtcgacggtcaccttggcgatggcctgccctgtgaggtcctcgacgatctcggcgatggcctgctggagcgggtgcgcgggatcgagacagtcgtcgagggaccagccgttgagcttcgccgtgtacagcatggccgcgtgcttgccggagcagttctgggcgagccgggacggcagccgcccctggcgcacccaggactcccgcacgaccgggtcgaacggcaggtcgggcacattgcgcagatcgtcctcggtgagcccggcccgctccaggatccgccgggtgccggccagatgccgctcctcgccggagtggctggcggcggccagcgagagcagttccccgtcgaggggcagcccggcccgcagcatcgccacggcctgtacgggcttgagggccgagcgtggatagaaggccgcctcgatgtcgccgatctgcaggtccacgttcccgtcggcgccgagcaccacgacggacccgtagtggatgccctcgatgaccccttcgcgtacgaggtgggcgacgggggtgtgcaggggctcccggatcacgggggcctcggccagagaactgccgtacagcaccgcctggttcacgcgtccgctccggaggccttgcgggcgacccggccgcgtacgccgtaccagccggccaccagcgccgccgcgatcagcggcaggcacagcaccgtcgtacggccggcgccgccgtcggcgtacatcaggacgagcacgctgacgaggaagccgatggtgacgatctcggtccacggcgagccggggaggcggtagctcggcctggacagctcgccggtgcgggtcttccgccagaacatgaggtggcagagcatgatcatgccccaggtggcgaggatgccgatcgccgcgaagttgagcacgatctcgaaggcgtcggccgggaccacgaagttgaggccgacgccgaggatacagatgccgctggtgagcaggatgccgccgtaggggacctggctgcggctcatcacgccggtgaacttcggcgcggagccggacatggccatggagcgcaggatgcggccggtggagtacaggccggagttgagcgaggacatggccgcggtgaggacgacgaggttcatcacgccgcccgccgccgggacgccgatgttggagaggacggtcacgaaggggctctggccggcggtgtacttgttccagggcagcagcatcgacagcaggacgaccgagccgacgtagaagaggccgacgcgccacatgatcgagttgatcgccttcggcatgatcttctcggggttctcggtctcgcccgccgcgacaccgaccagctcgacggaggcgtacgcgaagacgacgccctggatgatcagcagcatcggcagcaggccgtgggggaagatgccgccgtggtcggtgatcagggacgggccggggtggtggccgtcgaccgggtgctgggtgaccagcaggaagatgccgatgagcatgaagacgacgagcgcgctgaccttgatgatcgcgaaccagaactccagttcgccgaacatgcgtacggagatcaggttcacggtgaggacgacggcgagcgcgatcagtgcgatcacccactgcgggatgtcggagaacatgccccagtagtgggtgtagacggccaccgcggtgatgtcggcgataccggtggtggcccagttgaggaagtacatccagccggccgtgtacgcgcccttctcgccgaggaactcccgggcgtacgacacgaaggcgccggaggagggccggtacaggacgagttcgccgagcgcccggacgacgaggaaggcgaagatcccgcagaccgcgtacgcgacgaagagggacggtcccgcgtcggcgaggcgaccgcccgcgccgaggaagagcccggtgccgatggcgccgccgatggcgatcatgttgacgtgccgggacttcagggacttggcgtagcccgcgtctccggcgtcgacgtgccgcgagggctgcgtcccggtccgtatcgcgccttgggcctcgcctttgagggactgctcgctcacgcctggggtccgccttccgaaggggatggtgccgtggagtccgtggggatctgggtgggggtgtccgtgcgcggggtgcgcacgatgtcggtgagggtcgtctcgacgcggtccaggtggtgggacatggcctccaccgcgtcgtgctcgctgcggtcgatcagcgcctcgacgatcgcccggtgctcgcggttggactgttcgcgacggccgcccagttcgttgaggaaggccgactgacgcgccagcgcgtcgcggatctcctcgatcacccggcggaagaccgggttctgggcggcctcggcgaccgtgaggtggaagagcgtgtccatcgcgacccacgcggtggtgtccgtctcccgctccatgcggtccaggagatgggcgaggtggtcgaggttctcgggagtgcgccgcagcgccgcgtacccggcgaccgggatctcgacgtggcggcggacttccagcaggtcgctggccacgtagtcgccgaaggtggggtcctcgaccgtgtgagccaggacgaaggtgcccttgccggtgcgggacgcggtcagccccatcacctggagggcgcgcagggcctcgcggagcaccggcctgctgacttccaggcgtcggcacagctcggcctcggagggaagcttctcgccgatggcgtagtcgccgcgctcgatggcgccgcgaaggtggctgagcaccgcttccatggcgctgacgcgccgcggtaccgcaccacctgtctggctgtctgacaggttcacgggtgtgatcctccgggtaacgggaggcgactgtcaagggtctgaaaatgagaatcggcgcccgcggaacggacgccgattctcgtaccgcggacggactcagctgagcacacccgtgccgagcaggcccaggagcagcacgccgatgacgatccggtagatcacgaaggcgttgaaggagtgcttggcgacgaacttcagcagccaggagatggagccgtacgcgaccacgaaggacacgatcgtgccgacggccagcggggcgacgcccacgcccgtgcccagggcgtccttcagctcgtacaggccggctccggtgagggcggggatgccgaggaagaaggagaggcgggtggcggcgacgcggtcgaggtcgaggatgagcgcggtggacatcgtggcgccggagcgggagaagcccggaaagagcagcgcgaggatctgggagctgccgaccagcatcgcgtccttgaaggaggtgtcgtcctcgccgcgcttgtgccggcccatctggtccgccgcccacatcacgccactgccgacgatcagcgaggccgcgaccacccacagcgaggcgagcgggccctcgatgagggacttggcggccaggcccacgatcacgatcgggatggtggcgtagatgacccaccaggcgaacttgtagtcgtggtggtgacgctcgtcgcggttgcgcagtccgcgtccccacgcggagacgatccgcacgatgtccttgaagaagtacacgagcacggccgcgatcgcgccgacctggatgacggccgagaacccgacgacggcgttgtcgtcgacgggaatccccatcagcccctcggtgatcttgaggtggccggtggaggagacgggaaggaactcggtcacgccctcgacggctccgaggacgacggcctgaccgacgttgatgacgctcatgggatccagttctggggttggtcgacagtgttgtagacagtcttactacgcgcgggtgcactccggccgctacgcccacagagcctgggcgaaccagaccccggcgaatgccgcgccgagccccgccgccacactcgcgatcgcgttggcggcagcgtagaaccccgcgccggtctcggtgagccgtagtgtctcgtacgagaacgtcgagtatgtcgtcagcgccccgcacagacccgtgccgaggaggagctccaggtgcggggaggcgacgcccgccgaggccgcgccggtcaggaggccgaggacgagacagcccgtgacgttgatggcgaaggtaccccaggggaagacggcgtcatgcctgagctgcaccatccggtcggtcacgtaccgcaggggcgcgccgaccatggcaccggcgatcaccagcagccaattcacaacgacttctcacctttccggcccgggttctcgcgggccgcgtaccggatgacctcgcagtcgtcgaggatcagcgcggagccgccgaagccctcgattccccggaagacgctcgctcccgccagtccggccgcgtgggcgcggtgcacgatctccgtgtagagcggcttgtggtgccaggtgtcgctctcgccgatgaggaccgtcacgcggagcgcgccgcctgtgagccttgtcatcgccgcctccgtacgaggacgcggcgggccgccgtcgccgcgagccggaccgccgcgagggccgcgagcagggtcgcggcgaggtaggccagcgcggtgcgtggatggcccgcgtcgaccagcttctggatgtcgacggcgtacgtcgagaaggtggtgaagccgccgagcaccccggtgccgaagaagggccgtaccagtcggtgggccggccacacatcggtgatcacgaccatgaagacgccgatcacggcgcagccgacgacgttgacccagaaggtggtccaggggaatccgcccgactgcgtgggccacagcagcgcggccgcgtaccgggcggtgccgccgatgccgccgccgagcgcgacgaccgccacgacgggggcctggccgtgccaggcggagcgccgtcgggcgggggcgcgtacggcgatgccgggttcgccgacgctttcggggtgcgggactgtcatgtacgtacgtctcctactcgccggggcgcgggctcccgggcactcccccgagctctgggcttcgctcgagcggggaggtgcccctgtcgcaagtagggaccgttggcggccgcggtgccgcggttcgggtacggcgggccccaccgccgtgccgcgaggcaagaatcgcggccgatgaacaggttagcgccgacggcagtggccccgcacccgggtcagccggctcctgcgggcaggccgcacacggcgaccccgcgctccccaggggcccggctgaccggttcgcgacgcggggccgggctcgccgattcatcacccgagggccgggcccacacaacaccgcccgagaccgggctcgggggttcaccggcccgggtatgccgtgcttccgcggcagcgggagcggtaccggcgtcgcgcgatcaccagcccttctcgaacatgcgtccgacctcggcgatgcggacttcgtcgcggcggtagtacgtgcgtcggcggatcctcttcgtgcgcaggagaccgatgccggcgaggaggccgagatgggtgtcggcgaccgctctgcggacgccgagcttcaccgcgacggccgccgcggtgacgccgtcctcgacgaggtcgccgtgccggtccggcggaaagtgtgcggccgggtccttcagccactccaggatctccaggcgtttctcgctgatgggtagcttcagcatctcgaccctccgtccgagcctccacgcgcctcgtggtcctctgtcaatgtcccgcagacccggccgccgcgtccgggactccgcgacccttgtccaaggccgttcggtcgcccggcgcaaacagcgagggcccggccgccctccggcggccgggccccgtcaccgcggactcagcggtggctgaacaacgtcatcgccggcagcgccttgtcgtcgtagccgaacagggcctggttctcccagccgttgccggaggccgcgtcggccgggtcccagccgttgccggtgaccgccgtccaggtggcctcccagtagaagacgccgaggccacggccgttgggcacggcctccacgatgttcatcacgtcgcgcagccaggcggactgcccggccgtggtggcggcgtaaccggacaccagctcaccggtggtgtcgatctggttggtgagcgagtcgtcgctgtcgagacggaaggggtaggccgtctcggcgaggaagaccggcttgccgtaccgggacgccgcgtcgtccaacgtggtctggaagtcgtacagcgaaccgtgccagtaaccgtagtacgacagaccgatggcgtcgaagttcacgccgcccgccaccgccttgtcgaaccacgcgcgggttcccgcgaggtcgccgcccttggcgaggtgcagcgccacgaccgtggacgaggagaccgccttggtcgcgctgtagccggagttgagcaggccggcgagctgcggccagttgtccgtggagccctcggaccacagcatgccgccgttgatctcgttgccgatctgcaccatgtcggccgtggtgccctgcgacttgagggcgctcaggacgtcgtacgtgtggttgtagacgtccgtcttgagctggctgtacgagtgcccggcccaggcggccggcttgctctgcgcgcccgggtcggcccaggtgtccgagtagtggaagtcgacgagcagcttcatgccctgcgccttgacgcgcttggccatggcgaggacgcgcgtcttgttgttgtagccgtcggccgggttcacccacaccttgaggcgggcgtagttcataccggcggacttgaggatggtgagggcgtcgccggtcgtgccggagccggtcttgtagacaccgccgaacgcctcgctcttggccagcgacgagatgtcggagcccttgatgccgagtccggtcgtgccggaggtgaaggtcaggtcgtcgacgttgagccagttgcccgcgttggcgtcggagttgacgctgatcgtgcactggttgccggtcaccgcgacgggggtcacgatccggatccagccgccggcggacaccggcaggtccgtgcgctgctcggtgcctccgcagttcttcagcgccagataggcggagttctggccgccgcccgagcggacccaggcggtgagcgtgtagttcccgttggccagcccggacaggtactggtacgtctcgaccttgtaggccgaggccgaccagtgcgtgaggcggtaactgccgctgcgcccaccggactcggtgaaggaggcggcgttctggccggccgccgagtacgtcgaccagccggccggcgtcgcggtgccggtgccgtccgactcgaagccgggattggtgagcgtggcggcggcccgtgccgaggtggcgggcagggtggtgagcgccagacctgcgaagagcggtatcagcagggcccgtagggcgcgtctcgcgtggaacatcgtcgtcccttcgacgaaggcgggggacctgaaggagcggagctgtgacggcgccgtgcccgaaccgctccggacacggcgccgccgggaccggccggaggtccccccaggagtccggccggggtcttggggggtcagccgtcgagtcgtacgaccctgacggcgcccgcgggcacggacacctgtccggcggcgcgctcacccgtgagcagctcggtgccgtgggcgtcgagcggcaccttggtgtcgagcgcggtgtggttgacggcgaacaggaaggtgccggactcgcccgtgcggcacaccacttcgacatcgcggggcagatcggcgcgcggcgcgatccgggcgtcgtcggcggcccggcccagaagggcgtcgaggccctgggcggtcagccgggtggagacgtaccaggcggagccctcgccgaaccggtgccgggtgaccgcggggtggcccgcggtgagcccgtcggcgtacgtccagacggtctcggcgccgcggggcaccacgaactcgctccacacgtcgcccgtgagctcggagccgtcggggccggtgacgcggatccggtcgtccttcaggagcggcgagaactcctcgacggtcaggccgagtacgtcacgcagggcgcccgggtaggggccgtcgtgcacggcgtcgtgctcgtcgacgatgccggagaagtaggagacgacaagggtgccgccgttctcgacgtactcctcgaggttgttcccggcggcctcggtcatcaggtagagcgcgggcacgacgaccagcgggtaggccgacaggtcggcttccgggtgcgcgaagtcgacggtcaggtggcggtcgtagagcgcctcgtagaacgcgtcggcacgctcgcgcggatcgtggtcctcgctggggcgccactggaggttctgcgcccaccaggactgccagtcccacaggacggccacgtcggcgcgggtccgggtcccgcggatcgaacgcaacgagtcgacggaggagccgagttcgaccacctcgcgccacacccgtgtgtccgtgccgccgtgcggcagcatcgacgagtggaacttctccgcgccgcgccgggactgccgccactggaagaacatcgcgccctcggagccgcgtgccacatgggcgagggagttgcgggccatctggccgggagccttggcggggttgtggggctgccagttgacgcccgaggtggagtgttcgagcagcagccagggggcgccgctcgccacggaacgcgtgaggtcggcggccatcgcgaggttgacgtgggtgcggcggccgtcggtgatcaggtagtggtcgttggtgacgaggtcgacctcgcggccccaggcccagtagtccacggagtcgcactggctcagggcggtcatgaagttggtggtcaccgggatgccgggcgcgaggcggtgcaggatgtcccgctcggcgacgaagttctcgcgcatggtggcgtcggcgaaccgcttgtggtcgagcgcctggcccggattgccgaccgtgggcgtcaggcgcggcgggttgatctggtcgaagccggcgtagcgctggccccagaaggcggtgccccatgcctcgttgagggcgtcgatcgttccgtaggtgtccgtgagccagcggcggaaatgggcggcgcagctctcgcagtagcaggccgagacggggacgccgtactcgttgtggacgtgccacagcgcgagggcggggtgctcggcgtagcgggtggcgagccgggtggtgatgttcgcggcggcggcccggtagtccgcgttgctgtggcagatggcgccgcgggagccgaactcgtagcgggtgccgtcggcggtcaccggcagcgcttcggggtgggcgcggtagaaccaggcgggcggtgccaccgtaggcgtgccgaggtccgcgcggatgccgttctcgtgcagcaggtcgagcaggcggtcgagccagccgaagtcgtaggcgcccggcgagggttcgagcagtgcccaggagaagatgccgacgctcaccatggtgacgccggcctctcgcatcagccggacgtcctcctgccatacggtttccggccactgctcggggttgtagtccccaccgaaggcgagcctggtgaggcccttgggggtggtctccggcatggatttctcccggttaatcgatcatttgggaacgtgcacacacatcgacagcggcacgagcccaacataaccgcacagcaacaaccattgacaagtgtcctggatgtttctctactgtgaacgctcacagaagcatggcaggtcctccgcagcaggcggagacccaggtcaggggagaaagatccatgccaaacacgaagcactgccgcctcgtggccaccgccctcgccgtcgcgctcggcgccaccacgctcgccgcctgcggctcgtccgacgacgacagcgacgcccggtcggggcccgcctcgctgacgtactggacctggacgccgggcatggacaaggtcgtggacctgtggaacaagggcccgggcaagaagcagcagatcaccgtcacggtgaagaagcaggcgtccggcgacaccctggtcaccaagatcctcaccgcgcacaaggccaagaaggcgcccgacctggtgcaggccgagtaccaggcgctgccgaccctggtcagcaatgacgccctcgccgacatctcgaagaacgcgggcgacgcgaagggcaagttcgccgagggcgtctggcagcagaccacgctcggctcggacgcggtctacgcgataccgcaggacatcgggccgatgatgttctactaccgcgaggacctcttcaagaagtacggcctgacggtgccgacgacctgggagcagttcgcgaagaccgcccgcgcgctgaagcacaaggccccggacaaggacctcaccaccttctcctccaacgactccggcctcttcgcgggtctcgcgcagcaggccggcgccaagtggtggaccacctcgggccagaagtggaaggtcggcatcaacgacgcggcgtcgcagaaggtcgccgacttctggggcgggctcgtcaaggagggggcgatcgacaaccagccgatgtacaccccggcctggaacaaggcgctcaacaccggcaagcagatcgcctgggtgagcgcggtgtgggcgccgggcacgctgaccagcggcgcgcccgacaccaagggcaagtggaagatggccccactgccccagtggggcgacagcgacagcgtcaccggcagctggggcggttcgtcgaccgccgtcaccacggactcgaagcaccaggcggccgccgcgaagttcgcgacctggctgaacacggatcccaaggcgctgaccgccctcgcgaaggagagcggcatctacccggccgccaccacggcgcagaccagtgacgcgttccaggaaccgccggccttcttctccaaccagccggacttctacccgcaggccgcgaagatcgccaagacgaccgcgccgtccgcctggggcccgaacgtgaacgtcgcgtacacgaccttcaaggacgccttcgccgccgccgccaagaacaagtcggacttcggtgccgccctggccaagatgcaggacgacacggtcgccgacctgaagaagcagggcttcgaggtctccgagtgaccagtgcgcgccggacgtcgtacggggtcaagggggccccgtacgccttcctcctccccgcggcgaccctcttcgcgctgttcttcgcactgcccatcgggtacgcggtctggctcagtctccacaaggtgcgcgtctttggcctcggcctgggagcgggcgcccggaaagaggtctgggcgggcctggagaactacaccgacgccctcaccgactccgcgctgctccacggcgcgctgcgcgtggtcggctacggtgccatcgtcgtcccggtgatgctcggcctcgccctggtgttcgcgctgatgctcgacaccgaccgggtccggctggcccccttcacccggctcgcgatcttcctgccgtacgccattcccggcgtcgtggcggcgctgctctggggcttcctgtacctgccggacgtcagcccgttctactacgtgctgaacgggctcggcctgccgcagcccgacctgctggacggcggcccgctgtatctcgccctgtcgaacatcgcggtgtggggcggcaccggcttcaacatgatcgtcatctacacctcgctccaggccatcccggtggaggtgtacgaggcggcgaagctggacggcgccaccccgctccagatcgcgctgaagatcaagatcccgatggtggctccgtcgctggtgctcaccttcttcttctcgatcatcgcgacgctccaggtgttcagcgagccgaccaccctcaaaccgctcaccaactccgtttccacgacctggagtccgctgatgaaggtgtaccaggacgccttcggcaagggcgacatctacgcggccgccgcagaggccgcgatcatcgccgtcgtcacgctcgttctgtccttcggcttcctgcgggccgcgaactccggcaacaagcaggaggaagcacgatgagttctcttgcgctgcgcaagtccgcaccggccgccggtacgacgcccggcaccgcccagggtccgccgctgcgccgccggatcgccctggtcccgacgctgacgctgctgctcggcgccctgtactgcctgctgccggtcgcctgggtggtgatcgcggccaccaagtcgggccgtgagctgttctccaccttcaccttcctgccgggcaccggcttcacccagaacctcaaggacctcaacgcctaccgcgacggcctctactggacgtggatgggcaactcggccctctacgcgggcctcggcgccctcctgtcgacggccgtgtcggcgctcagcggctacgcgctcgcggtctaccgcttccgcggccgcgagaccgtcttcaacgtcctgatggcgggcgtactgatgccgccggtcatcctcgcgatcccgcagtacctgctgctggccaaggcggacctcacggattcgtacgcgtccgtgctgctgccgctgatcctgtccccgtacggcgtgtacctcgcccggatctacgcgagtgccgcggtgcccggtgacgtcgtcgaggccgggcggatggacggggcgagcgagtggcggatcttcatccggatcgcgctgccgatgatggtgcccggcctggtgacggtgttcctgttccagttcgtcgccgtctggaacaacttcctgctgccgtacatcatgctcagcgacgacgagaagttccccatcacgctcggtctgttcacgctcctcgagcagggcgccaacaccccggcgttgtacacgctggtgatcactggggccacgctggcggtcctcccgctgatcgccctgttcctggtcatccagcggttctggagtctggatctgctgtccggggccgtaaagtcatgaccatgcacgcgacgggcggcaggcgcaggccgccgacgatccatgacgtggcgcgcgaggccggtgtctcgcgcggcacggtgtcccgggtactcaacggcgggcactacgtcagcccggcggcgcaagaggcggtcaacgccgccatccgcaggacgggctacgtcgtgaaccggcacgcccgctccctgatcaccgggcggtccgactcgatcggcttcctgctgaccgagcctcaggagcggttcttcgaggaccccaacttcaatgtgctgctgcgcggctgtacgcaggcgctggcctcgcacgacatccctctgctgctcatgctcgccggcaccaaggacgaacggcggcgcataacgcggtacatcacggcgggccatgtcgacggggtgctgctggtctccagccactcgggcgatccggtcgcggaggagctgcgggaggcgggcgtaccgctggtcgcctgcggcaagccgatcgggctgggctccaaggtgagttacgtcgcggcggacgaccgggacggcgcccgtgacatggtgcgccatctgctgtcgctgggccgccgccgcgtcggcgtggtcaccggaccgctcgacactccgggcggtgtggagcggctcgcgggctaccgggaggtgctcgccgaggcgggcctcgagtacgacgagcggctcgtcgtccccggcgactacagccgggcgagcggtgcggccggcgccgagcggctgctggagcgggcgccggagatcgacgcggtcttcgtggcgtccgacctgatggcgcagggtgtgctgacggtgctccgacaggccgggcgccgggtccccgaggacgtggccgtgggcggcttcgacgactcccccgccgccaccgcgtccactccgtcgctcaccaccatccgccagccctgggaccggatcagcaacgagatggtacgcgtgctgctggcccagatcggcggcgaggacccggcggcggtgatcctgcccacggagctggtcaggcgggagtcgacttgaggagtgcggggagggagcgggcggcgggggtcgggtccccgcgggctcagagccccgcggcgcgcacggcctgctccgcgaggaggccgcggcccgtgccctcccgtgtcgccggcgccgtccgcacgccgtgcaccgcagacggtcaggattgaagaagccggaccgggcttcctccgcctagcgtgaaagcgccggcccgatcgccggcgcccaccgcaccacggaggagtacgtcatgaccgccggcctcaagaccatcatctaccccgtcaaggatctcgctcgggcgaaggcgctgttcggcgcgctgctgggcgtggagccctacgcggacgaaccgtattacgtgggcttcaaggacgcggggcaggacgtcgggctcgaccccaacggacacgccaaggggatgaccggcccggtgccctactggcacgtgaccgacatcaggtcccgcctgtcggccctcctgaacgccggggccgagccccttcaggacgtccaggacgtcggcggcggccggctgatcgccttcgtgaaggacgcggacgggaacctcatcgggctcatccaggagccggccgcacaccagtgatccctggccggccccggtcgggtggttgcagctgcactagttgcatggtcaatgaatggccggttttctgttaccttgcagccatggcagcgaaaacgaccggtgcccggctcgaggagcagtggcgggacatcctgtcggtgcacgcccgcacgatgtgcgagatcgaccgtgcgctccacccgtacggcctcggcgccagcgacttcgaggtactcgacatcctcgcgacggagtcggccgaggccggcgaccagtgccgtgtgcagaacatcgccggccgggtccatctgagccagagcgccctgtcccgcctgatcggccggctggcgaaggacggtctggtggagcgctccgtctgcgaggaggaccggcgcggagtgtgggtcgccctcacccgcaagggacgcgacctgcacgccgaggcactgccgctgcaacgggccgccctggcccgcgtgttgaacgcctaggaccgtccggcggtcaggccctgccccgtacggacgaccagctcgccgtcgtggaacccggtgtgatcaccgccgttctggaccgtgcggccggtgcgcacgggctgcggtacgcgcccgatccggcgagcgcggccctgtcgacgatcggcgggaacatcgcgaccaacgcgggcggtctgcgctgcgcgaagtacggcgtgacccgggacagcgtgctgggtctggaggcggtgctcgcggacggcacggtcgtgggcacgggccgccgtacggtcaagggcgtgaccggctacgacctcaccgccctgctcaccggctccgagggcaccctggcggtgatcacgtcggcgactgtacggctgcggcccgtgccggtggcgacggccacgctcgccgccttcttcgactccttcgaggcggccgccgaggcctcgtacgcgatcggccgggccggtatcgagcccgcgctcgcggaactggtcgacggtccggtcctgcacgccatcgacccggcgctgcgggagcgcggcgcggcgctgctgctcgtgcagtgcgacggcgcgggcgcggccgccgaggcggaagtggtcgcccgggtgctcgcgccgtccgccacggccgtcgagacgaccacggaccctgtcgaggccgagtccctgctcgccgcccgacggctcgccctgcccgctctcgaacggctcggacgcccgctcatcgaggacatcgcggtgccccgctcccggctcgcggaggccgttcgcgagatccgcgccatctccgcacgccatgacgtgcccgtcttcaccatcgcgcacgcggcggacgggaacctgcacccgatcatcgtggtggaccggtccctgccggggctccccgacgcggcctgggaggcggcgggcgagatcttcgcactggccctgcggctgggcggcacgctgacgggtgagcacggcgtgggcgtcctgaagcggcagtgggtggcggacgaactggggcccgcggcccacgcgttgcaacggaggatcaaacgggcgttcgaccccaggggggtccttaaccccggaaagtgcctttgaggcagggccggccgggacgcactcacctcggccgcttcgcacagcgctgacgggcccggctcggggagtcgccaccgcagttccgccgcagcctgtgagctgaccgccggtgccccccggggcccggccgctgcccgttcaccgtggccgggcccgcttcccacgggcccgggcgccggatgacttcacgcggagggccgggccagcagggtgcgtacgccgtcggagtcgagcgtcagtccgtgcggtgagccggcgtcgatggcgagcgagagaccggcggacggccactgcgaggcgagcgcgccgagcggcaccacccggtagcgcgagacgaacggcagcagttcggccatggccggctccgaggtgaacacgggcacggtctgttcgccgcccgactcctccaggacgggcagggccacgatcgaggggtcggaggcgtccggctcggcggcgtcgtcggggacgggcaccagcacctcgctgtcggccagcgtgtccagcgcctccgtgtccatcgtgtggacggagagtgcggtcagcgcctcctgcgctgcggcggcggtctcgggcgtcgggcggtcgttcgagggtgtgtccatgaggtattcccaggtagtggcgggtgggacgccggggccgacaagatccgccccggctgcgattcgggtcgcgtacccgtccccagccggggcatgcctgcgggtgcggtcaggtcaccgggggtggtcggcaagcacgtcgtccaccacaccccgcgtgcccggcgtcggtcaggggaccgcggccgggcacgcgatggacgggaccgccttcggcacatggacgccggagccggccggctcctggtgccgggccgcggccgagcacggagggtccgacggcggcgacgccctgggcgcgggcgcgctcgaccgcctcctcggccgccgtggacagggccaccggtccgggggcgcggtcggcggacacggtggccacggccgggaacgtggactcgacggtgatgtccggccgggggttcgcctcccccgacgcgaggagttccagacgatcgccatgctcgacgtggcggcgggcgagggagcgttgcgtacggtcgtgacccggccgaggcggtggatgcggaagtcgcccacgagggtgccgtcgcggtccagcgcctgggcccgtacgccgttcttggtccgtacgacgtccctggcgccgatgtcgggcacgtaccgccgcgcggccttcatgtaggcggaggcggagagcgagccggcgtcccgaaggaaggaagcgcccgagcgacaggcgcaaaatgggagatatggatgcccgccgtgtgtcagtggaccgcctcgtggggcggtcgtcgggccaggggctggtggcgatcccgctcgcgctgatcgtggtgatcaccgtggtggacatccactccccttcgaccatccatctgggtccgttgctggtcatcgcacccgcactcaccgcctccatcgccgggccgcggctgaccgctctggtcggggtggtggctgtggccgcccaggtgttcatcgcggtgttccacggcgggctggccacggccaaccacatcgcgcagatcatcgccctgtccgtgctctccgcactggtggtcttcgtctgccatgtacgggagcggcgggatcgggagctgagccgggcgcgatcggtggccgagacggcgcagttggctctgctgcggccgccgccccgccggatcgggccgttgcgcgtcgcctggctgtacatgaccgccgaggacgagacccagatcgggggcgacctcttcgcggtcgcccgcgccgcccacccctccacccgggtgatcatcggcgacgtccgcggcaagggcctggcctccatcggcgaggcatcggtggtgctgggctcgttccgtgagggcgcccaccgctacgccaccctgcccgagctgacggcggcgctcgaggtgagcgtgtgccgggacctggaggacgtggccgatacgaggcacgaccccggagagcacttcaccaccgcactcgtactcgacatccccgacgacgactcacaggccgagatgatcgactgcggccatcccccacccctgctgctgcacgatcaccaggtcacggtcctgtacccccgccgtcccgtacccccgctgggcatgtgcgaactgcccgccgcgagccaccgcaccgacccgttcgccttcgaacccgacgacatcctcctgctctacaccgatggcgtcatcgaagcccgctcaccaacgggcgccttctacccactcgccgagcgggtcgcctccttccccacctccagccccgacaccctgctgcgccacatccacgatgacctgctccaccacatcggcggccaacccgccgacgacgccgccctcctgatcatcgaacgcaccgcctcccacctccaccggccgcacctcccggcccgcaccctggacggccgccggcggatccaccacggtggatcctcttgacctgccgtcggcaccacgcacccgccgcactggccccgtgcaagagcccgctctccgccgcggagcgcgtctccgctcagccgccggcggcctgggcaacgacagcagcgcgcacgtgggaacaacttccgtcaacgactgtcctggggatgcgcatccggcgcagcagaccacgcgtgaggcgatggtcgagcgtggtgcgccaggtgacaccgggatgccgggagcgcagatgcagcagcgccctcgtgcccagcccgctgtcgcggaacggcccatcgaggaccacatcggtgatcacgccctcggcgcactcgtcacacgcctgatacgtcacccggccgaccaccttgcggatgtgcaccagcagcagacagtcctcaccccggccgtcaggcgcggggcactgcaccagctcgacatcgcgataggcgagcagcctgcgatgccaccggccccctcgccgtccggaacgccggtgcctgccctcggcccgccgcggtgaggcgccggcccgtgacccgggcaaccggccgtgcacggcggtcatcaccgatgtctggtttccctgcatgccatcgcgtgtgccccgatatcagggaccaatgtccgcaccgggcgatgcacgcgtcggcccgcgtgccgtcaggactgctccggctccgtccgcactcccatcaccgctgatcacccagccgctgatcacccagctgatgacccagcctgatcggcctggacaggtccccggaccactcttccagcgaaccgtcgtacaggctgatgtcctcacggccgagcagcgtcagggcgagtgcggtgccggcggccgagatgccaccaccgcagtagaggacgacgggcgactcggcgtcctggagaactgcgccggtgcgccgggcgagttcggagcggggcaggagtcgcccggtggcatcgagcagaccgcgtcccgggaggctgaggctgccgggaatgtggccccggcggctgtagcgcgtggcggcagagccgtcgaagccgccgggcggcagggcgcacaccagtgtgccgggacgctcacctcgactgatggcggccacctcgtcgataccggtccacacatcgggacgaggtaccggcgtgagcggccgcgagacccgcacggcacccgtctcgtcgccgtgggcgaccgggtgcccgccctcctcccagacggcccaccctccgtcaagtaccgccgccggtacggagatcgaccgcagcatccaccacagccgggccgcccagatgccgccgccgctgtcgtacgcgacgacctcggagccgtcgcgcacaccgagccgctggagagcgtcggccagcgccctcggagacgggaccgcgaagtggtacggcgcctcgtggtcggacaggtcacccgtgaggtcggcgtggcgggagcccgggatgtggcgctcggcccactgggcgtggccgctgccggaccggtggtcgccgtcgtggcggggcgacggcagcagcgcggtggcgtcgaggacgaccagtcgggggtcgtcgaggtgggccgcgagccaggcgtcgtcgacgagcggtccggaaagcagggcgtcggtcatggccgggatgctaacccggcggcggatagaggccgcccctgaactgcgatatctcgcccactgggcaagggtgtcccacattctggaagccgtttgcgcagcatcggttgcctggggttatggtttcggccatctacgcgggagcccctacccgattgggctgagagggcgtctgggatccaagtcggcgcgagccgaccggtccccatgggaacgccgaccgcatcacttgagccatagtgcccgcgtaggagtaccgcatgtcttcggcagtcgagcagcagtgtcccccggcctccgccgcggcgccccgctcctgttgttgacccggaccggactcctccctcctcccgttctctctttcctccctttccttcttcaccaggcccacgcgcctgagtgccctccgcggagttgtctctcgatgtcgcacgtccgagtcatgctcgactacttccacccttggccgaattcggccggtttgtacgtcgcccgggagcgcggctggtaccgcgaggccggcctcgacgtggaactcgccgtccaggacccgggacgtggcgacacccttgagtacctggcccgcggcgaggtggacctcggcctcttcccgcccaatcgcctcctcgcgcgccgggccgcccacgcccagcccctgctcgccgtcgccgccgtcaaccaccgcgccctggaggcggtacagaccgcccgctccaccggcatcacgcgccctcgcgacctcgccgggcgccgcctcgcctacaacccgacgccccgcggccgcgccatggtccggcacctggtcgcgaccgacggcggcgacccggacgcggtgatcaccgtcgattcgggctaccgcgaactcaccgtcgacgacatagcggccggcgaggccgacgccaccttcggcaactactggtcctgggacgccctgcgcggcgatctgcccgaagagcaccggctgacctggccggtcgacgagatcggcgcaccccgctaccacagctacctcctcggcacgagcgaggccttcgccgacaccgagcccggcctgatacgcgccttcctgtccgccaccgcccgcggctacgccgccgcggccgccgaacaggaccgcgcgcaagcgctgttggagcgggtgattccgtacttctcccgccccctgatcgcccgctccctggccctcgtcgccccgacctggaccggcgccgacgcacgctggggcgtcatcgacgagacccgcatgggcccgtacgccgactggctcgcccggcacggcgccatcgcgcacgcccgcgactgggcgtcgtcctacacgaacgaactgctcgaaaccaccgccccggcggtcagcacatgacctgccaggcacgggaactgacgaggcgtatggccgtcgacctcatgcgggtcaacagcgcgctgtgtcgggcgtgaggagcactgccacgccttcatcgccgccctaccccctccgaggatccccatgagaccccgtacgaccgccctgctcgccctggccaccgccgccgccctcaccgcgaccggctgcgcagcccaggactccacctccgccgcgacgaagaacggcaccacccaggtcaccctggccctggactggacgcccaacaccaaccacaccggcatctacgtcgcccagcagaaggggtggttcaaggacgccgggatcgacctgcggatcgtgccgtacggctcgaccgcacccgagacgctcgtcgcgaaccacaaggcggacttcggaatctcgtaccaggagggcgtcaccaccgcgcgctccgcgggccaggacatcacctccgtgtacgccgtcacacagaagacgaacgtcacggtctccgtgcgcgccgaccgtgacgacatcaagtcccccaaggacctggacggcaagacgtacgccggcttcggcgccccgtacgagaaggccctgctccagaaggtcatccaggaggacggcggcaagggcgacttcaagcaggtcacgctgaacacctcggcgtacgcggcgctgtacgcgggcaaggcggacttcgcgatgccgatgccgacctgggagggcctggaggcgaagctgacgggcaagcccctcaaggacttccagctcgccgaccacggcttcccggccatctactcgacgctcgtcgcctcctccgggcagtacctgaagcagaaccccgaagtcgccaagaagttcctggccgtggtcgacaaggggtacgagtacgccgccggccatcccggccgggccgccgacctcctcatcgcggcgaacaagagcacgctcaccaacaccgaactggtcaagaagagcgagacgttgctcgccaaggagtactaccgcgccgccgacggcacgatcggcacccagaccgccgagcgctggcaggacttcgccgacttcgagttcagggccgggctgctgacggacaagaacggcaagaagctcaccaaggcccccgacgcctccacctacttcaccgacgcgtacctcccggacacgaagtgagggcggtcctgcgtgccgtctggccgccgctcctcgtcctcgtcgtgctcgtgaccggctggcagtggtacgtgagtgccgccggtgtcgacccgacggtgctgcccggccccggtcgcgtgctgtccgaggggtggtcaaaccgtaccgatctgtgggaccagaccctgcccaccctccaggagaccctgctcggcttcgcgctctccttcgccgccgcctggctggtggccgtggtgctggacttctccgccgtggcccggcggggcctgtatccgctcctggtggcctcgcagaccatcccgatcgtcgccgtcgcgccgctgctgatcatctggttcggcttcggactgctgccgaagatgctggtggtgacgctgacgacgttcttcccgctcgcggcgaacctggcggcgggcttcgccgccaccgaccgcgacgcgatgcggctgctgcgctcgctgggcacgggccggctgcgcgccttccgtctggtccgcgtcccgagcgcgctgccgcacttcttcaccgggctgcgcgtgagcatcacgtacgccgtcgtcggcgccgtcttcgccgagtacgcgggcgcggagaagggcctcgggatctatatgcaggcgcagaagagcgcgttccgcacggacctggtgttcgcggcggtcaccgtgaccgcgctgctgagcatcgccctgttcggggcgacctgtctgctccagcggctcgtgctgccgtgggagcgggcgctggtgaaggagggcacgtcatgagtctcgaagtgcgcggagcgggcaaggcgttcggcacgctcgaagtgctgcgcgagctcgaactcagcgtgcggccgggcgagttcgcggccgtcatcggtccgagcggcagcggtaagagcaccctcttcaacctgatctcagggctggacacccccacctccggcgagatcctcgtcgacggcgccccggcgtcggtggcctccggcaaggtcgcgtacatgccgcagaaggacctgctgttcccctggcgcaccgtgctcgacaacaccgcgctgggactcgaggcgcagggcgtacggaagaaggaggcgcggcgccgggcgggcgagctcttcgaggccttcggcctggacggcttccagtcctcctaccccttccagctcagcggcggtatgcggcagcgcgcggccctgctgcgcaccgtcgtcctggaacggcccgtgctgctgctcgacgagccgttcggcgcgctcgactcactcacccgcaccgagatgcagctgtggctggccgacatgtggcagcgctatcgctggaccgtcgtcctggtcacgcacgacatccgcgaggccgtgctgctggccgacaccgtgcatgtgctctcgccccggccggccaccgtcgtcgagcgcgtcgaggtgccgcgctccggtccgcgcggcctggacgccctcgccgaaccggagttcgcggcgaccgaaagacgtgtcctggacgctctgcgcggcccgaccgcggtgacagcggcggtcacgaccgccatgacaacagcggtgagcgcgacgtgagttcacatcttgcgcacggcatgggaaccgaaccggtcgagcccgactggcccccgctgaccgaggccgaggtggcggatgtcgtgggaccgtcgcgggtggtgtggcgcagcccgcgcccgctgtcggcggccgctgtcgtcgaacgcgggggacgccgcctgttcgtcaagcggcatcacctgagcgtgcggacgcccgaaggcctcgcggaggagcatgccttcctgcggcatctgcgcgaacgcggggctccggtggtggaggtgctggacgtcgcgacacggcaggagtgggtgtacgaggtccactcggccggcctgggcacggatctgtaccgggacgatctgtcctggtcgccgttccggtccagcacacacgcacgggccgcgggcgcggcgctcgcccggctccatctggccgcggacggattcgaggcgccccgccggattccgcagccgctggtggcctcgttcacgatcttcgccgcggacgaccccggtacagccctggagcggtacgtggccgagcggcccgccctggccggggcgctggcggaccatccgtggcgtgcggacacccgccgtgtcctgctgcccctcttcgagcgcttggccccgcatctgccccttctggagcctctctggacccacaacgactggcatgcctcgaacctgttgtgggacgcctccggagaggtctccaccgtgctcgacttcgggatgagcgaccgcacgaccgccgtccacgacctggccacggcgatcgaacgcaacgccgtccaatggctgcaaccaggctttccggtgcgcgagcaggacgtcgacgcgctcctggacggctaccagtccgttcggccactcaccgtgtccgagtcggcggcactgcccgagctgctccctctggtgcacgcggagttcgcgctgtccgagatgggctacttccacggcatcaccgggtccgcggagaatacgcggctcgcgtacgcgtacctggtcgaccacgccgagtggttcaccggcgacgccggctcgcacctggtcgacagggtgcggcaccgggcagccgccgcgccgaagcctccccctgccggaaggccgctctcggatgcctcctcctaggacaccggggcaccgcccccggttaccgtgcggggtcatgcgcccggcaccccgaccagagcgaccagagcgaccagagcgaccagagcgaccagaaagaggagccggcatgcccggcgaagacacctccgcgcccggcttcctcgctctcggcgcgctgccgtgctccgccgaggaggtgtgacgtccacgagcgtgtcgctgcgtggcgcggatgcgatgagcctggcaacgcgcgaacggtcgcctcgtatccggacgagtgagcgcgacgtcaggagcgcggacacgtggcggcgtcgacgcgcgccagatccacatgcagtctgcggtgcagcactggagtgctcacctcaccatgtccagcaggcgggcgcgggacggaccgttgcggccgcatgaaaatccgacgggccggcgcgcggagccatcacctgcgaacgcggtgtttccgttctgcgaacaggaagccgtggccggggacacgcgccgtcgggcggtgtgaccatgtgcgcatgctcccgggagaaggtcacgccgcccggcgggtgttgatggtgtgcatggcggccggggtcacgaccctgctcgaccagtcggtcctcaacatcgcggtaccggcgctgcgtcagtcactggaggcgggttccaccgatgtgcaatggatcgtcgccggatactcgctgacgttcggtctcatgctcgtgcccggtggcagcctcggcgatgtgcacgggcgcaaaggcctgttcctggtgggcctgtcggtcttcgttctcttcggcgtgatcgccgccaccggtgtgcggccggagatggtgatcgccgcacggctgatgcagggcgccggggccggcctcgtcaactcccaggtcatcggcacccttcaagatgtcttcaccggccaggaccgggctcgcgcgctaggcctgtacgccgtcaccggcgggctcgccgcggcactgggaccggcgctcggcggcacgctcgtcgcggccttcggcccggagctcgggtggcggctgtgtctgctcctgagcacaccctgcggagtgatcactctctggctcgcggccctttggcttccgcgggcgcggcggcccgacggacgaagtcggctcgactggtgggggctgctgtgggtgggtgcgctgacgttgacgctgatgctgcccttcatcagcacaccgagcagcggcggcgaggcggcgctgtgggccggcgccgcagtcgtcctgaccgcctgcttcgttctggggcagcgactgcgcgtacgggcggggcgggcgccgctggtgcatccgtcgctcgcccgctcgcttccgtacacgctcgggacggccgttgcgatggcgagcttcgggtcctcgctggccgcgacgctcgtcctgaccatgttcctgcagagcggtctcgggctttccgctccggccgcggcactggtcactctcccggcggcgctggccatggggggcgcgtcggcggtggcgtggcgcacggtccgccgccttgggccgcacacggtcacgctgggactcgccctggggatcctcgcgctgctcgcggcggccgcgggcgccgtcatcgcatcgcgcaccgcgctcccgtgggtgctcgccgccgttcagttgtgctccggtgccgcctcgggcctcaccgtctcacccaaccaggcccaagtgctccagcacgccccggccgaggccgcgggcgtggcgggcggcattctccagatggcccagcgcatcgccgcggcggtggccctgagcgcggtctccgggagctatctgcgcggcgtggccggggcggcgggtgcgccccgtgcggctttcgcccacgccatgctcatctgtgccgctctgctcgccctggccgtcgccctgtccttgttgcgctctcaccgcacgggcccgcggcgccctcctacgctgctggctcccgggcacccgcaagccacacccgcacccgttcacgaggaaccgtgacgtccctgccgccctgcgacgcgggagcggacctgcgcggggcgccaggccgccggcgccgtggacgcgggccgacgcatcgacgagggcatgcgcggctgcgcccccgacgtctggccggacgacaccagggggcgacgcgtcaccggacctgccgtcccccgtcccgttgcgtcattttcccttgggtcgcaggaccttcccgccgtgccagcggcagacgttgagggcgaagtggaggtcgaaggcgttggcgtcgaggtcgagtcggtagtggtcgacggcgcgctggacgcggtagtggacggtgttgcggtggaccgtcaagtggtccgcggtggcggcgtagctgcggttggtggcgaggaagacgcggagcgtctcgcggaggacttcgttgcggggatcgtcgacggcgaggtcgccgagggtgtcggagacgaagtcggccagttcgcggggctcgtcgaccaggagggcgacgggagcgacgcgggcgaaggcgaccgcccggggcgcggtgggtcccgcggagagggcgagggccttcgcacgggcggcggcacgcgtgctgcgacggaaaccgtcgagtcccgggcggacgctgccgagggcgacccgcaccggcagcgcggcgtcggccagttcggcggccaccgtgtcggcgtccaccgggcagtcgggcctgacggcaagccagatccggacgccggcctcgtcggtgtggatcagcagggggcggccgtgggcgcgcagcacggtgtgcagcagcgaggccagccggtcgaaaacggcggtggggtcggtggtcgccgcggtgccgtcgagccagccctccacgcccagatggctgccggacaaccggtagccgagggcggcctcggcctgccgctgatccaccctgggattgtcgaggagctgagtgacccagtgccggcgcagtacaccgcgggtgcccacccagcgttcgcgctcctcctcgtagacgcgggcgatctggtcgcagacccggtccacataggccgagctgaggctgaccagggtgatgagggtgccggcgatgtccggcaggttcagtcggaccgcctcgccgaggaccagatccaggctctgcgcatggccgaggcggtaggcgcgcagcagggccgagagcgggacgtctcgctgggcgaggcggcgggcgtacgagacggccgaggcgggggcgtcgacggtccccggatcgatgcggttgatgacgacgtgcagggaggtgacgatgttctcggtgatgctggcttccagcagtccgcgcagcggttcgtcgtgttccagctgggagatctccgcctccgtggtggcgaccagcttggcgatgaactcgtcccggtgcgcctgcatcacctgggccgcgaggacggccgggtccggcgccccgtccgccggccgctgcgcggggccgttcaccggtcgaggtaccgcagcgcggatcgggcggcgttcgcaccgcacatgccatgcaccccggcgccgggcggggtggccgccgagcacaggtagacgccggggatgccggtgctgtaggggtcgagggccacgcgggggcgcagcgcgacctgccgtgcggtgttggcaccgccgacgatgtcgccgccgacgaagttcgtgttggagcgggccagttcggcggtcgagcgcgccgcgatccccacgatccggtccctgaagcccggtgcgaaccgctcgatctgccgcaggaccgcctcggtggcgtcaccgggatagccgtgcgggacgtgcgcgtacgcccagatcgggtggacgtcgccgcgggagcggctggggtcggcgaggtactgctggccgaccaggacgaacgggcgctcgggcatccgcccccctgcggtctgcgcctcggtgcggacgacctcttccagggtgccgcccaggtgcacggtgcccgcgcggcggcatgcctcatgggtccaggggatgccgtcctggacggcgaggtccaccttgaacgcggccgggccgtgccgccagccctcgtaggcgctgcgcacccggccgggcagccggtcgccgcagatccgtgccgccgcgccgggcgcggtgtcgagcatgacgatccgggcggcggcgagttggtccagggagtccacccgcacccccgtctcgatggtcccgccgagctgggcgagcagtgcggccagcgcatcggtgatggtgcgcgacccgccgcgggcgaccggccagccgaagcggtgggcggcgccgacgagcatcagccccaccgcggaactggtgggccccgtcagtggatgcatcaggtgcgccgccgcccccgcgaacagcgccctggcctccgcaccgcgccagcgccgggccaccgtcgtggccggctggagcgcccggagcccgaagcgggccagctccaccgggtgggcgggcagatgggggaccggacgcagcagatcctcggtgagtgcgtcgaagtcctcggccagcggggcgaacagccgctcccaggccgggccgtccgggccgagtccgcgcacggtccgctccatggaacggaccagcaccccggcccgcccgccgtccagtggatgggccaggtcgacgtcgggccacgcccaggtgacgccgtaccgctccaggccgagggtccgcaggaacggcgagccgacgcccagcgggtgcacggcggagcagtggtcgtgcagcagcccgggaacggtcagttcgctggtccgggtgccgccgccgatctcgtcggcggcctccaggaccgtcaccttcaggccccgccgcgccagggcgacggcggcggccagcccgttcggcccggcccccaccacgatcgcgtcactcatgtgcggccgccgcctcggtcaccggtcgcggtgcctcgatgggctcgacggggatcgcgggcgtgtcgtcgtcgagccagggctgccggaccaccatgtcccgcacgttcacatagccctcctcgatcaggccgctcgccgcgtccacgatgcggtagtgctggcgcgagcggtgcgtcggctgcgactcgagcaggacgacgcgcagctcgcccggcgcgaagccgcaccgctgctgcacggcggccaccagctgctcgttgtgcagatggccgtcgccgaagttccagccgaggaccgctcccgccaccatctcgccctcgcgtacatcgtaggactccacgtcgtccacggctcgcggcagcagcccgaccagcgcgcggccgtggctgtgcatggcgcgccaggccagcccctggtgcagcacgagctcggcggtgtcggcgccgtacaggcgggtgagctggtcgacgggcagaccggacgccttgacgatgtgctcgttgagccggtgctcggtgcccttgcggaaacaccacaggccggtggcccagttgccggcgtagtagcgcatcgaagggaggaacgacaccaggtcggggcggacatggccgagcaccgggaccatgaccaggctcagcaccaacaccgcggccagcgccggggagtgcagcgcgaaggcaccgaccgcggcgtcgtggccgaagaggacgagcgccgagtagatgaagaagacgttccactccagcggcacgcccatcgggaaggtcgacatgatgtgcaggtggaagacgaccatcacggccagcgcgacggtggtgacggtcccgccgtgcgagagcaccaggaccagcggcaccacgtactcgatgaccgtgccgccgtgcgcggccgcggcggccaggccggacggccgcagatcgtcggggtagtgccggtacagccggcgcttgagccaggcgggacgcagcggactgttgctgatcatcaccgccaccacgaacgggaagtggcggttgagcttggaggtggcggcgccccaccacagggcgagcatgatcagcttcagtgcggcggtcatgtcggccgccgggaagaggaagaccagcagtgtcagtccgtagtgctcggcgcgagcggcgaggaagacggtcttgtcgcgcagcccgagcagcgcgagtgccgcggcgagcacggcgacgcgccacggagccgccacgccggccgcccccgggccgcccggtgcgcacagcagccacccggccgcccccagcaccgccgcgtacagggtcacatcggccgccgtccgccgggtccccgaggtgaacgggatcctgtccggccacggtggcagccgtacggtgccggggcgcagccagtgcaggaaggcgccgaccggcggcaggaagtgtgagctgagcgggccggagccgcagccgaggcccagaacctcgtacaacagcgtccagacgacgagtttctggtagacgagcggctcggcccaccatgagccgaagtgcgcgatgccgccgacgccgggggtcagggagacgaccgcgatgccgccgagcgcgtacgccgtgatcttcaccaggtacagcaggtgcacgatgccgggggtaccgaagccgtgcccggcccagtgctcggcgagcggcctgatgcgttgctggtacgggcgggtgcgccactgccggatgtcgacgtccgccatgttcggtgcgaggaatcccatgactgtctccgtgtccgttcagccggccgtggtgagggcggtggtcccggaccggagcgcgggcttgtccgtcttgccgacggggttcctggggagccggccgacgagggtgatccccgtcggcactttgaactcggccagccgcgcccggcagtggtcgagcaggtcggccgtggtggccgacgcgcccgggcgcagcgccacgaaggccaccggtacctcgccgagccgcggttcggcggcgcccacgacggcggcttccagcacctcggggtggtcgccgaggacggtctcgatctccttggggtagatgttctcgccgccccggatgatcaggtccttgatgcggtcgaccagcaccagatagccgtcctcgtcgaagcggccgacatcgcccgtgtgcagccagccgtcgatcacggtgcgggcggtctcctccgggcggcccagatagccgcgcatcacgttgggaccgcgtaccaccacctcaccggtcgcccccgctggggcgatccggccctgcgggtccatgacggcgacctgctgtccgggcaacggcagtccgaccgtcccgggcttgcgccggccgtacagcgggttggtggtggaggcgcaggtcccctcggagaggccgtagccctccaggaccgggatgtcgtagcggcgctcgaaccgctcgatgagcgcggccggcatcggcgccgccccgcaggcggcgaaccgtaccgacgaggtgtcgggccgtacgtggtccggcagttcggcgagcatcgagtagatcgccgggaccgcggagaagcaggtcgggcggaccgtggcgaccaggtcgaagaaggtctccgcccggaaccgcccggccaccgtgacccggccgccggccagcagcggggacaacacgccgaccacgatcccgttgacgtggaacagcggcaggatcagcaggctgtggtcggtctcggtcagccgggcggtgccggtcatcatctccgccatggcggcgaggttggcgtggtcgagcatcacacccttggggcgcccggtgctgccgctggtgtagatcagcagggcgagcgcgcccgcgtccgtctccggggcggtcgtgtcctcggggccggtgctcagctcggccacgggcagcgccccggcgagcggtgacggtccggcggtgacggccaccgcggctcccgcgtcgccgagttggtaccgcacctcgctctcggtgagtgccgggttgaccggggtgacagcggcgccgagccgccaggcggcgaagagcgcgacgacgaagtccgccgtgttgggcagcagcagcgccaccacgtcgccgcgtccgacgccccgcgcccgcagggccgacgccgcccggcgcacccgccgggcgaacgccgcgttgtccagatctgccgcgtcgtcagctatacaggcaccgtccgcgtcctgtcgggcccgcagatctggcagttccgcactgtgcatgtcggctcctcgaagtacgtcggcggacgtcggacggacggggtgcgcgtcccgaggcgggacggatgtccggtacgtgaggagagacggtacgaatcggcggtgcccccggcccatgggcgcgggcgacgacgctcgggccggtccttgtgcgcggcgcacgaggccgggggcgggagggccacgatggtgccggcgcacgagagcggggcgggacgccacaagcacacccggcgcccaagaacccggcaggacacccgcaatggaccgcgccggcgccgaggcacggttgcactcggggccggcgcgggggtcggtggggctgtggtgggaggtcgggcaagaggccctgccccgcgccggcggcgagcgatgtgctccgggtcggcgcgggtcgtcggggaccgcggtcagacgaaggcgctctcgccggtgaccgccttgccgacgatgagcgtgttcatctcacgggtgccttcgaaggagtagatcgcctccgcgtcggcgaagaaccgggcgatgtcgtagtcgagcacgatcccgttgccgccgaagatctcccggcaccacgccaccacttcgcgcatccgcgaggtgacgaacgccttcgccagcgaggagtgctcgtcgcggaagacaccggcgtcctggagtcgcgcgagctggaccagcatgccccagcaggcggtgatgttgccgaggctcttgaccaacaggtcctgcaccatctggaaccgtgcgatcgggcggccgaactgcttgcgctccttggcgtagcccagcgccagctcgtaggcgccgagcatcacgccgagggcctgccaggcgaccccgctgcgggtggcgcggaggatctccgccacgtcgcggaaggagtcgatgcgctggaggcggttggcctcgggcaccttgacgtcggtcagggtgatctcggcgttctccacgatcctgaacgcgatcttgttctcgatcttcaccggggagaagcccggggtgcccttctccaccacgaagcccttgaccttgccgtccgcctcgtcgcgggcccagaccaccaccagatcggcgaacgtcgcgttgccgatccaccgcttggcgccgttgagcacccagttctccccgtcccggcgagccgtggtccgcatgccgccggccacgtcggagccgccgaggggttcggtcatcgcgaaggcgccgatggtgtccagcgcggccatcgagggcagccagcggtctcgctgctcctggtcgccgccgcggtagatgctgtacatcgccaggccgctgtgtacgccgaagaacgtggcactggaggcgtcggtgcgggtgtactccatcgacagcatgccgaccagcagattgctcccggccggcagcgggtcgccgtacccctcgtagggaacgcccgcgagtccgaggtcgcggaacttgccgatgagctcgcgggggaactcgcccttcgcccagtactcgttgaccagcggcttgacctcggtgcgcatgaacgcccgggcgtgcgtcagcagttcgcgctcatgcggcggcagcagcgactcgatgtcgtagaagtcggcggccaaccgctcgtcgacggatgtcttctcgggcagcagggcggtcatgaccgggtctccttctccaggtgggtggcgctgtcccgggcggacagcacggcgatctgccgggcgtcgcgctcctggctgaggtcggcgtaggagcgggagccgtaggcgttctcgacggcctcgaccagccgttcgacgtgttcggggctctgctcggggcggccgagcgagtcccacatcttctgcatcgacacgccgatgtgctcggccatgtgccggtagccgccggggccgccgccgaggtgcgcgccgaggaacgggcccaccgtggcccagcgcaggccgagcgagttcaccatcacggtgtccagttccgccgggctgacgacgccctgctcgacgaggtagatcgcctcccggctgagggcgttctggaggcggttgccgacgaacccggggatctccttgcgttccacgaccgggacccggccgacgaagcggtagaactccacggcccgcgccacgctctcctccgaggtgcgctcgccgggcaccacctccaccagcggcaccaggtgcggcgggttgaaggggtggccgatcaggatccggccggcgtcctcgatggtgtccgtgaacgccgtggcggggatcgccgaggaggagctgagcaacagcgcgtgcgcgggggcggtaccgaccaggtcggtgaacagttcccgcttgaaggcggcgttctcggggccgttctcctggacgacgtcggcgtcgcgcaccgcgtcggcgaggtcgtcggcgatcagcacccgctcggcgaggccgtgcacgtccaggccctgggcggccagctgcccggccgcctggtcgagtgcctcggcgaccgcctcggccaggtccggtcgcgggtcggtgatccgtacccgtatgccgtgccccgcgaagagcgcggcccaggacagtccgatcgtcccggcgccgaccaccgcggcggcggtgaatggcttggtcatcacatgtcttctttctgcgtccgtgaccgtggccgcgctcaccgcgtggggtacgcggggtgggccaggtagtcgtggaccggcttgaccggcgcgagggtcagatcggtgaggatgtggctggcggagatgacctcgcgcaccggcagatcggccagcggcgccagcacgtgctggaacagctgaagccgggcggggccggtccaggcacccttcaccgtgatgtcggtgatctcgttgcgcaccaactgcgcgacctgcggcgccccgtcgaagccggggaccagcttgagcatgtaggtcggcacaccgacctgggccacggcctcctcgaccgacaactcgtagtgcttgtagcccatggtggcggtcgccacccggagcgtgccgacgtcgaggacgccgaccagcgcgccgtgttcggcgtagaggccgggcgagccggcggtcttggggtaggcactggcctcgcggccggaggtgatggccggaaggttgtccaggtacatggcgtgcaggtactcgccccgctccccctggtaggtgaccgggatcgcctggcccgactcggtgtacgggccgtacccgctgacgtcgcccatccgcatgacctcgaagcgcaccagcggttcgtcgatctccaacggttccggcaccaccgcgcgcagggcctcgtggtcggtgcggtagacgatgttgaggtactcgcggttggtgaaccgcggcacgaccggcggataggccgggttggccagcggcgtcgcgaagtgccggggcacgtcctgctgattcatggtgggttctccctcgggttctaccggccctgccagaccggggagcggcgctcggtgaaggcggtcatgccctcgcgcacgtcggcggaggccgcgagagtggccatcagccgcccctgtacggcgaacgcctcctcctcgggcgcgccgtccgcggcgcggacgaggttcttgacggcggccagggccagcggggcgttctgcgcgatccgctcggccaggtgcagtgcggtggcgacggtctcccccgccgcgaccacacggttggcgatgccgagctgtccggcccgttcgccggagaccggctcgccggtgagcagcagttccatcgccaggtggtacgggatgcgcttgggcagccggatcactccgccgcccgccgcgatcagcccgcggccgacctccggcagaccgaacctggcgtcgtccgcggcgacgatcagatcgcagcccagggccagttcgaatccgccgcccatcgcccagccctcgacggccgcgatcagcggcttggtggtccgcgcccgggtgagcccgccgaagccgcgccccgggatctcgggcgattcaccggccagcgcggccttgaggtccatcccggcgctgaacgtgccctgggcgccggtgagcaccgctgcgcgcagggcggggtccgcctccaactggtctatggcgaaagcaagttgagtggctacggcggcgttgaccgcgttgcgcgccttcggccggtcgatggtgatgagcagggacgaaccgatggtctcggtccgcacctcggtggtgctgtgcatggtgtgaatccttggtcgacggtgagtcagcggccggtggcgagctcgccgaagacctcttcggtgtgctggccgggcagcggggcgagccggcggaccgatcccggggtggcggagaaccgcacggggatgccgaccgtgcggatggcgccctcgctggggtggtccaccacatccagcagccggccgccgcgcacatacgggtcctcggcggctcgctcgagctcgagcacgggtgccatcgggatgctgtgcttggcgcagacccgggcccactcctcggtggtcatgctcggcgagcactcccccaccagttccatcagcgcgtcgacgtcgtcatcggcgacggcctcgccgttgacccgcgggtccgcggcgaggtcggcgcgatcggcggcgaggaagaagtcccggaagttctgcgggttgtacgggatgacgcaggcgaggccgtccctggtgggcaccgcgcggtgcccgcgcttcatcgacagcgggaacccggtgggaccctccggcggctcgaagacatggcccgccaggtgctcgacgaggttgaaggcgatgagcgtgtcggtcatcgggatctcgatgtactggccggcgccggtggggccgcggtggaccagcgcggcgagcaccgtgtagacgatggtcagcgcgcagaccttgtcgccgatgatcgtcggcagatacgccggggtgcccagcgcccggttggccacgtccacgagtccggaggcggcctgcaccgtctcgtcgtaggccgcgttgccggcccggtcggagtcgctgcggaacccctgggcgtgggcgtagaccaggccggggttgcgggcggcgacgtcggcgtgggcgaggccgaggcgggcgagggcgccggggcgcatgttggtgacgagcacgtcggcgctgtcgatcagctccagggcccgtgcccggtcggcgtcgtccttcaggttcaacgacacgctgcgcttgttgcgattgacgttgaggttgagcggggtcatgccgggtgtggtgcggtaggggcccacccgtacggtgtcggacggggactcgatcttgatgacgtcggcgccgaggtcgcccaggatctgcgccgcgtagggccccatcaccaccgtcgacagatcgatcacccgcacgccgttgagcggaccggtgtcgcctgcggtcgtgctgtccatcatcgctccgttccacgcagtaatttcgtggtgaatgttttcaccgacgacgttatgcgcgaacgagccgagagggaatgatcaatggacgaacaagggtatgaccacagcggtcacaccctttccatggacccccggaaaaggatccaagaaaagggccccagaaattggtcagacggagatgacctcgtggaagatctgccgcgcccgcgcggcgacgtcactcaggtcaccgccgtcgtccgctcggtccctacggaacaacaggcctgtcaccagggccggttggaagtcctcgacgggcagtacaaccacattgtccagccggtacagatgcatcggactctccggcgagagcatggtcatcgagaacgccatgccggacgaaatcaattccgagcttcccgaataatccgccatatttatgcggatccttttcttcacgccgacggaattcagatgggcgtcgatttcctcgaaataggccggggtggcgtcgttcggcgtggccacataggacagatcggccagctcgtccagggtgaccgacgcccgccccgcgaaccggtcggccggcaccgcggcacccagccgctcccgcatcacctcgatgatctccagcgcgggatcggagaccggcagccggaccagcgccatcgccagcctcccgtcgtgcacggcgtccgcgagatccgccgacgtaccgggccagcgcttgagttcgcacacctcccggcaggcgtcctccagcagccggacccgctcccgcagcagcggatgcactcctgcgggcatcccgatgaacagcctgtccagccgcggccgcaccgcctcgctcagccgccagggaatcgcgttgacccgctccaggatgtcgcgcgccatcggcagcagtgcggagcccgccggggtcaggtcgacccggtgggtggtgcgctcgaagagctcgtagccgagttcgcgttccagatccttgatccgctggctcagcggagaggccgccatgtgcaacttgcgcgccgcctgcgagaagttgagttcctcggcgacggcgacgaagtaacgcaggtgcagcatgtccacgccgtcaccctacccatggctggatcccccggcggcagaggcgtcgaaggaggcagccggtgcgccggtaccgttcacccgcgcacgcgacgcagggccgcgccccgtccgacacagggccgcaccttcactcaccgcggtcgggagcggtcggccgacctcgtgcgggcctgggacgagacgcggtcgtctaccagcccaccgcgaccagcagccactgcgggttgctgtgcgagatgaaggacgactgactcgccacgtcgtcgtagggaaagccgtaggcgaggcggttgatggcgttgtcgtgccagaacttggcgtagtagttcgccggcgccgccttgtagtactgggccggatcggcttgctgggaggccggcagcgtggccacgtgccggttgagggccgcgcacacgtcggggtggccggccaaggaggcggcgcagccgaagatgtcggaggtggccgcgttgacgccgacggactgggcgtaggaggtgaagtagttggcgttggcgccgcccgcgcggaagctcgggtcactgccgggcgcgatgatccggtacgggccctgggtccgggtcagtaccttgaactcggccgggaccgcgtcggtgaagcgctggaaggtggcggcgcggtcctcggcgaaggtctgccggttctcgccgacctcgacgtcgtagttgtccttggtgtgcagtcgcacggcgagcttgaggccgaaggcgtcgacccgggtggtgttgccgttgaagacgttgttgccgaccgtgaactcgatgaagtcgtagtaggggctgtcgggtgtgcccaggtggaagtacatgcgccccgcggagttcgccggcatgtcgaggtagggctgttcggcgatggagtggacctggccgttgaagctccagtacacctggctgtcggggtactttccgttggtgcggttgaggatcttcacttggacggcgttgttcgcggggggaatgtcgctggtgctgccccagaagtcgtcctgcggaggggtgccgccgggcccgtacacctcgaactcccacagggagtggccgtattgagtggccctcgccgttgcgaggatgcgcacatagcggccactgccggtgacgggcaggctctgggtgccgccggcggctgtggtggtggagtagatcgtcgtccagctgctcgcgttggtggacgtctggagctggtaggccgtggcgtaggcggcttcccagcgcaggccgacgcgggtgatctgctggacggagccgaggtccacctggagccactggggatcggcgaaggccgaggaccagcgggtgcccgggtccccgtcgaccgccgcggctgcggggaaggccgaactctcggtcgaggacgccgtggcgggccgcccctgcgacagcagcaggtcggcggcccacgcgggcgagggcgtcatggcgacgaagcaggctgcgagcaaggcgacgaccaggccgagagccgtccgggagcgggcggcaccggtcgatggtctgcgcgcgggagcacaggacgaagtctgcatggggagctccggaagccgagccggcgtgcatggaggggggaggagcaacagcaggcgggagagcgctctctctcacggggtttgtacccctgcccctgcccggcgtcaacaactgaaggcagaaccagcacagttcacaggaacgaggcggcgcgcggtgtccgcggtgacgacgtcacacaaagcaccgagcatccatcccctgcccatcggcaacgcccagctgggcggaaatgcccctgggaccgtggccgcaacgccacgcgggggatccgacccctggtgcggccgcttcgggttccgagcgcttgccccggtccaaggcgacgtctcctttcaccacttgacgtgtctggttcagacctttaggttccggccagtcaggctttgtgaaggcactcagggttcagtcagccgatccggcgcatcgtctccgagcctccgcagtcgtacccgctgtgatcgtcttccatggccggaggccgccccacggccggacctgctgtcacttcgtgttctgcagggcccccgcgacctgggcctcgtccgaatccgcaggtgtgaacgacatttccggcggcgggacgcggaacatccgggtcaggtaggccaggtacaccacgccgaggcccaaccagatcaggcccagggtgagcgccctgccgtcgaggttgtacagcaggtagaggtccacgaccgcgccgatcgcgggggcgacgacgtacgacagcggattcagggtgtccccggcgcgccgacgccgtatgtacatggcgagtacggacacgttgacgaaggtgaaggcgacgaacgcgccgaagttgatgaaggacgtcgaggtggccacgtccaggcgcagggcgatcaggccgaccgcgccggtcagcacgatgttgagcgcgggggtgcggtagcgctcgtggaggcgggcgaagaccttgcgagggagggcgccgtcgcggcccatcgcgtacagcagtcgtgaggtgctcgcctgcgcggcgatgccggaggcgaactgcgcgaccacgagcccggccaggaacaccgacgagaacaggtcgccgccgatgctcttcgcgatctcgaaggcggcggagctggggtcgtcgaaggagctgcccgggtgggcgagctgcgtggtgtaggcgaccaggacgaagatgccgccgccgatcagcgccgtgagcaggatggcgcgcggcatggtgcgcttcgggtcgaccgtctcctccgtcagcgtggtgaccgcgtcgaagccgaggaaggagtacgcggcgatggcggcacccgccgagatgccggccgcggtggtcgcgccgttggcgaagggcgcgccgctcgccagcgcaccggcgccgccgatgtggaggacgtgacgcagggagaggacgacgaagatgccgatgaccagcacctggaagaccatgagcaggtcgttgacgcgctcggcggtcttgatgccccggatgttcagcacggtggtgacggcgatgaagccgatgatccatatccagctcggcacagcggggaactgcgcctggagatacgccccgccgatcagccagatgaccatcggcaggaagaagtagtcgagcagggtcacccagccgacgaggaagccgagccgcccgtcgatcgccttgcggacgtaggtgtaggcggagccggcgacgggatacgcggcggccatcttcccgtagctgtgggccgtgaacagcatggcgaccagggcgagcaggtacgcggtcgggaccgcgcccccggtgtcggcggcgaccacaccgaaggtgcccagcacgatcagtggagtcatgtaggcgagaccgaacagggtgacggctctgagggtgagggagcgcgcgagagcgggcgcgccggtggcgtggttgaccatggggtggctccggggacgtacgagcgggacggagaagggtgaggagccggagtgtcaggctccgggacgccaggtgcgcgggtcgatacggccgccgtacagcggcagttcgatgggcgcgtcggtgtcggtgaactggtcccacatgcggttcacgcctgcggtgccgtgggtccggacgcgggtcacgtcgtccagatcgatcacgtcggtgaggatggcggtgccgtcgccgggcgcctctgcccggatccggccctcggggtcgacgaccaggctgtgcccgctgcccagggggcccgcggtgttcacgctgaccacgtggacctggttgacgatggcgttggcgcgggccaggacgacctcctgggcgcggtcgctggtggtggtcatcacggggttgacgatgacctcggcgccgcgccacgccagatggcgggcgacctccgggaaccaggcgtcgtagcagatcgcgaagccgatccgccccgcctccgggacgtcgaagaccacgaaccggtcgccgggatcgtagggctcgctcggccgccaggggaacaccttgcggtaccaggccgccagacgcccctgcggggagaaggccagggcggtgttgaacagttccccggccggcccgcgctcgcacaccgagcccgggagcagccacacccccagatccccggcaagctcggcgagctccttgacccggggtccgtccaggggttccgcgatctcccgcagctgctcgtgcgcctcggcgccgagggcgtcgacgccgcacaggtgcagctcggggaagaccgccatgcgggtgtgcgggaaccgggcgagaatgctctccgcctcagccgcgaacccgctgagcggggcatgtgcgggccgcggggggagctgggcgagagcgaggggcagggggcgggacatggacgcgaaactagttcaagatgagcagttaaacaagagtgctcaatacgagcttttttagcgatgatccagcggagctggctagggtgacgccatgcctggcagtgacaacgtcccgaccaccggcctcaccgccctcgaactcagcggtgtgcgcaggctgtccgccctggaagcggtacgcgcccggatcgctctcgccgtcgacctgggcctgctctcccccggcgagcgcctgcccggcaccgcacagatcgcccgggccctcgacgtcagcgagatcaccgctcgccgcgccctggtctccctgtgcggcgacggcgtactggaacgccgccgtggccgtaacggcggcaccctcgtcgccgcccaccccaccccgggcacggtcctcaccacggagacctaccgcacggccaccgacgccgtgcaccggctgatcgaccaccggctggccctggagtgcggcatcgcccacctcgcgtcggtccgcgccagtggcgaagacctgtccgagctccaggaaatcgtcgaggaaatggaccgcgcgcccagctgggcggagttccacggctgcgacgagcgcttccacctccggctcgccgaggcgaccggcgtcccctcgatcaccggcccctacggcgcggtcctgcgcgagctctaccgctactaccttccctaccccgtggacgcgctgcgcgcctccaaccgcgagcaccgcgacctcctcgacgcgctgcgccgtcaggacaccgccgcggcgagcgaggccgcccggcaccatgtggaaacactgcgccacaccatgttcgtaggcctgctgagcgcatccgccgacaccggaaccgtcgccccgggaagctgagcctgtccgctggtgggcctggccgacccgtcgccgtgatctgttttcggcgcgcgggctgggacgggaactggtgtgctggtactggggccgtcattgagcagtcgttcccgttcccggagagatccccatgagtacttatcgagcagcgcaggtggccgccgcgagcggtccgttcgagatcgtccagcgtgaggtgccgcggcccggccccggccatgtccggatcgccgtggacgcctgcgggatctgccacagcgactccgtcttcgtcgacgccctgttgccgggcgtccggtttccgctggtccccgggcatgagatcgccgggcacatcgacgagctcggcgagggaacggacatcagctggcaggtgggcgaccgggtggcggtgggctggttcggcggcagctgcggccactgcccgccctgcagacagggcgacttcgtcgtgtgccagaacctgaaggtccccggatgggcgtacgacggaggctacgccgaggcggtgatcgcaccggccgacgccctggcccggatccccgacgcgctggcggcgaccgacgcggcacccctgggctgcgcgggagtgaccacgtacaacgggctgcgacgcagctccgcgcggccgggcgatctcgtcgccgtcctcggcatcggtggcctcggccacctgggggtgaagtacgcggccgccatgggcttcgagaccgtggccatcgcccgcggatccgacaaggccgacttcgccaagcagctcggcgcacaccactacatcgacagcacggcggacaccaccgtcgcggatgcgctgcagtccctcggcggcgccaaggccgtgctggccaccgccgccaactcggacgccatcacggcgaccgtggatgggctcgcgccccgcggcgagctggtggccatcggtgtggacgccgagccgctgggcatcagcccgaaccagctgctcatgggcggcaagatcatccgcggtcatccgtccggcaccgcgcaggacgtgcaggacaccatggcgttcagcgccctgcacgggatccggccgatgaccgagaccgtgccgctggaccaggccgatgaggcgtaccggaagatgatgtccggcgccgcccgcttccgcatggtgctcaccaccggctgacgtggcacgtgccgccccgccgcgccacaccagcggcggcatcgaggcgtccctgcgcgacccgacgccggtccccccgcactcgcgcggtgccggtcgcggttgcggcgtgggtccgccggtgtccgttcaatagccgatcgtgaagcggcgttggacgaagcggggcagttcggcctcgtcgacgagtgcgacggccgcgtcctccaccgagatgcggctacgcccctccgcgtcgagaaccggctgatcgccgccggtccggaaccggcccgtgcgctcgccgggagcgatgtcctccgcggggctgaagtaggtccacagccggttggacgtgcgcagcacgttcagcgcgtcccgatggccgcgcaccgcagccgcgtactgcctcggcaggccaagcgcgtcgagactcgagtgcaggagctcgtcggagtccgcacgtacgactccaggctcgatctccaggctgccggcaccaccgatgacgatcagacgggtccgggggtgactctccagcgccttcagcagggatcgcgcggcagtggcgtacaccgtgggatcggcgatggagcgggccacggtgtcggcgatgtccttggccgcgttgccgggctggaatccactgatcaacacgtcgaggccggatatgccggcggcgacgctcgcggcgtcgagcacgtcgaggctcttccagacgacgttcccgcggtcctcgtcgatctgcgtcgagtcgcgcgtgaaggccgtgacgtggtgcccccgggcgagggcttcggtgacgacacgactgccgatggtgccggtggctccgatgactccgaggtgcatggctctcccctgtagatacacatgccgcctgcccttcacggcacgcgaaaactatacgccgtgaagtatacggcgtgaagtaaatgtacggcactcaccatcgtgacgctgtagagtcagcgactgtgggaaagaccaatgggcgccgcgagcgactgcgagccgaaacgaccgccgagatcaagagggtcgcgctcgaactgatggccacaggcgggcccgacgcgatcacgctgcgggccatcgcccgcgagatgggcatgacggccaacgccatctacggctacttcgccacccgcgacgacctggtcaccacgctgatcaacgatgtgtacacctcgttggtcgacaccgtggacaccgcctgggagaccgcacccgcccaggatccggccgcccggatccaggcatgggcgtgcgccttcagaggctgggccctggccggccccgagggcttccggctcatttacggcgaccccgtacccggctaccggccccccgcggggggcgccgccccggacgccgcccaccgcgtctgcaagggcatcaccgcactggcggccgcagcctggccgcacgccgaacaccgctacgcggacagcgacttctcctggtccgacttcgacaccggcctcctggacaaggtccgcccggccttcccggaactgcctccggcggcggtggccctcgcgctgcgcatctggagccacctgcacggcctgatctcactggagatctacggccacctgcagacccagaccctcaacccggacaaactcttccgcgaggaactggcccagctcatccgctccttgagcatgaccccccaggggtagtgcgaacagcgccgcacgctcccatgaacaccgtggacacccacgccgatgtggacagcgccgaggcggggaagaccagcccaccgagggaatcggtcccgcgcggtgcgctctcccgtcaccggcgggcgatcatggtctcggggccggaaaagttgacgtaaggtagagcaagtcgacgcggggtggagcagctcggtagctcgctgggctcataacccagaggtcgcaggttcaaatcctgtccccgctactgaaacctgaggggccagcacggtgtgctggcccctcaggcatgtccggccccggggcacgcgtcaccacgaggatcgtgccggccgcgaggtcccggcacgctcgcggcgatgaccagtacggccaacagcggatcgagcgtctcgatgacgaccccccacttcctgccgacgatctcgctgccggcgatctcctcgccggcgccgacgccctggctcgcggcggcacactgcttccctctcacgcagtttcggatcaccacgttctcgtcgctgccgtaaccccggggcttccgcctcggtctccccactgtccggcgccctggccgtcgcccgcgcccacggcggcgacgcacgggcggcaaccagagcggaggaagggttgacggtgcagcgtcaggcgccagtggtacaacgcgacacggacgcctgatttcactcctatgacgggttactgggcgaacgctactttttaccggaaagcgaaaggagagacagtatgagtggttggaccttattcgaactctcacccgggggaactgccgatccggacaccggagttgccgcggtgtcccgcatccccggtcacatggaagtctggtgggtgggccccaacggctcggtggaaggcgcctattggtacgacggccacccctgggcccgctatcagatcgccccgaacggcagcgcggggggagcgagccggatcaccgcggtgtcccgcatccccggccacatggaaatctggtgggtgggccccaacggctcggtggaaggcgcctattggtacgacggccacccctgggcccgttaccagatcgccccgaacggcagcgcccggcgccatgggatcacggcggtctcccgcatccccggccacatggagctgtggtggatcggccccaacgcctcggtggaaggcgcctattggtacgagggcagctcgtgggcgcggtaccagatcgccccgaacgacagcgccgcgctgaacggaggcatcacggcggcgtcccggatccagggcagcatggaactgtggtgggtgggccccaacgaatcggtggaaggcgcctactggtacgacggccacccctgggcccgctaccagatcgccccggccggctccgcgtccgccgtcggcggcatcaccgcggtctcccgcatcccgggccacatggaggtctggtgggtgagccgcaacgagtccgtcgagggggcgtactggtacgagggcagccagtgggcccgctaccagatcgccccgaacggcagcggctaccggggctccgacctcaccgtggtctcccgcgtcccgggccacatggagctgtggtggacgggcaccgacaactcggtccagggcgcctactggtacgacggccacccctgggcccgctaccagctggcccccgccggcgcctcgtccggcgacggcatcgcctccgtgtcgcggatccccggcagcatggaggtctggtggctgaccgggcgccagtccatcgaggacggctactggtacgagtgacagcacgggcgcgcggcgaccgcccgtagcggcttcgtgctcggcagacaggccccgacctggagcatgaacgcctctcccccggctccaagagcaggtcctggccaccaggaatggcagccaggacctgtggggccggcgccgcccgtagatccacagcctccgtgacccctgcacgtgcgcaattccgccccgcggacccaacggacagctggagcgagggccggatccggacgaggccggggttcgacgggatgacggcgcccgggacacggggcgcggcaggcagtcgcgcggtccggggtcctcaggcgtccggcgcggacagccacgcgctgatgccggccatcgcgccggggccgctgtccgagcggacgttctggaccagatcggcgatcgagacggctcgcaacgccgctcgccaggccgcgtccgccccggtcatcgcgcgggcgatcgcacagggtacggcgcacgactcggccggtgtggccagtggacccctctgacggatctccgtgcaggtgaaggcctggtcgggaccgtcgaccgcttcgaccacatcgagcaccgtgatagaggcgggttcccgggtgagcacgtaaccgcccgccttgccctgcaccgaacgcacgagcccggcgcgagagagcgcctgcaactgcttggccagatagcttgccgagacgtcgtgcagctccgccagccgggtcgcggggacaggctcctcaaccgatgtgagcacgacgcagcaatgcagggcccactcgactccgccggacatcttcactcggtcactctaaccagatgcattgactcggacaacacatgtccacgtatagtcccggacagaacgtgtccgagtttcgcacatgcgacgcccgcatgggatcatgtgcaatattccggacatacctctcgtcgaaaggcatgtcatgaagttcgcggtcatcggcggtaccgggctgatcgggtcgcaggtcgtcaagaatctgaacgccgccgggcacgaggcggtaccgcactcgcagtccaccggaatcgacgtcatcagcggtcagggactggaccaggcggtggcgggggccgacgtcatcgtcaacctgacgaactccccgaccttcgacgaagcctccccggccttcttccagacctcgatggacaacctcctggccgcgggccggaaagccggcgtccgtcacttcgtcatcctctcgatcgtcggcgtggaccaggtgccggagctggactactaccgggccaaggcgctccaggagaaaatcctcgcggccggaccgatcccctactcgatcgtccgcgcgacgcagttcatggagttcatcgacgcggtcctgtcctggaccgcggacggcgacaccgtccggctgcccgccacgccgatccagccgatcgccgccaaggacgtggccgacgcggtggccgaagtcgccgcgggcgccccgctggggggcattcgcaacgtcgccggccccgagatcttctccctggacgagctgggccggatcaccctgtcccacaagtccgacggccgcaccgtcgtcaccgaccccaccgccggcatgttcggcgccgtcaagggtgacgtcctcaccgacaaggacgcccacctcgcccccacccactacgccgactggctctcctgaaccgctcgcgccctccccggcgcgcggacctcacgagctggtgctccccgcaaccgagccggctgcggggagcgggatgcgtccaatggagtggaacagcgctaaccgattcacctcagtgggcaataaaggccgagacgctgcccagcgacaggagaagcgcatgtccagccgtcggccaccacggagggacccgcgaagccatgcgcacggaccggcacgacgttggtggcgccgacactggaaagccggtaccgccgtcctttcggcgctcttcgtcgcgaccgcgagcccgctgatctacgacgcgatcaagagcgggacttcggcgatcgtggaaggcgacaggccgcccttcgcatggacgacacaagtggactcgccggaagatgccgggtgcaagtcctatgtcttcgactctgacgcgaagatgtcggctccctcgcccaacgaggactggcaggtttgggcaacccgccagggaggaaccgccgccaatctgacaaccatccggctcaccctgcaagggcgctccgccagcagtgtcgtcctccacggcctccgagtggacgtggaatcgaaaagcaggcccaaagggtccgtgtacgacctcggcctcagctgcggcgggctgacatctcgaaatttcgacatcaatctcgatgaccccgaagtcgctccggcatcgcgcgccggcgatgacggaactcctgctgcgcgtttcccctatcggatttcatccacagagccggaggtattcctggtccacgctcgtaccgagaattgtgattgcaggtttcacctgaacctcgactggaccagcggagaccgcaaagggaccctgcgaatcggcgacggaaagaatgcctttcgcgtcatcgggacgcagcggcttcggtggttcgagctggacatggacaagcagcaatgggtgaaacagccggttgtggacaccgttccaggagccgaactcggccgactggtaaagcgatcggatgttcggagggaagcggcctagcctctacgtcgcagccgtgccgagagatggtgctgcatcggctggccgaccgcctcgaggtcgtggtggaacgtgagcgtgtcgtcgtcggtcagggtgtagcggcggcgggtggcgttgaccttcttggccgtgggagcgagggcgacctcatgggtcgagaggtcgatcgtgttgccggtcgcacgcccgaccatgatctccgcgatgccggtcggctgggtgatcagcgcctccacccggccgtcgggctgaagccgccaccagccgcactcccgggccgacggacgcagcggtgcgtcatcggcgtcgagcagccaggcccgggcctcgtagcgcaggaaggggcggccgtcgtgactgaaggtcagctcctgcgcgtacccgaagtccccggtgagcgtcgggtacccgccctcgccccggccgtaccaagaacccaggaggccgagcacgggctcgagcagtgcgtgtggtgcgggcgcctcgtccggtcggtggccgtcggggtacgggtgctccggtgcggggtcaaccacggtgcgcgctcctggggtcggtgtcggtgtcgggtggaagcctaggctgtcggtccactcggaatgcgcgcgagaacggtgcgtcggacagcgctgccgcgtcgagccgagtcgatcaggcgcgggccgtgcggccggcaggcgcttccggcgcctcgtcgcggggccggaagtcgtctgtggaaacccccgccccattgatgagtcggcgtatcgcccgttccatgggccctgcccggcggtgttccgccgccggtacggattccgcaggggatggggagacggtggggcagtccagagcagactcgaagagaccgacgggattatccagagcacgaagaagcggcatttccggtgcggcggcgcttatcggcgtcgccgcactcgtcgtctcggcggtccccgccgacgcgaaggcggggggaccggtgccgccgccgagcccgggagagctgatcccggggcagaagacggcgacgcccgcactggtggagggcctccgggagcaggctccggcggcgcggaacgccgcgggcgcggcgcgcgcgtacctcgccgcgaagcaggaccgctaccggatcgcggacccgggccgcgacctggagcccctggggaccgtcacggccgacggccaggagaccgtgcgactgcggcagaggtaccacggcatcccggtcctgggcggccagtacgtcgtacgcatggagaagcaggacggcggacgggtcgtcaccggcacctcgggcaagtacttcaccggtctgcggaccggcaccacggccgaggtcgacgacgcgctcgccgtcgagcgggcggtcgacgcggtgctggcccggctcggcgcggagaagttcaccgcgtacggggaggacgacgagggcaagaaggacgcgacgccgctcaccggcacctcccacggcctggtcgtgctgcccaccggcacgggcgtactcgcccggcacgtcaccgtgcggggcgcggacccggcgcgcggtgagccggtgctgcgcgaggtgtacgtcgacgcgcaggccggatatccggtgctccagtacagcggtatccggacgttcgacgcgcccgggacgaccgccgaggggagcgcggcgagccaccccgcgcaggaacccaccgaacccgcccccggcgagacgggctccggcgtcaagctggacggcaaacccgtcgaactacaggtcacccacgacgacacgcgcgccgcctacgtcctgcgcgaccactcccgcatccacaacgacaccgcggacgtcctcgccacctgggacgcgcgcggcaagtgggcctccgacgtggtcggcaactggcccgccgaccttcaggagttcgcctcgccgaccccggccttcggcgccgaggcgaccgaggcgggggcggtggacgcgcactgggccgccgggcaggtgtacgactactacaagaacaagcacggccgggacagcctcgacgggcggggcatgtcgatcaactccctcgtcgggacgaccgattacgggcagccgtatgtcaacgccttctgggacggccagaagatggtgtacggcaacggcgacgccgaataccgtccgctcgccgccggactggacgtcgtagggcacgaaatgacccacggcgtcgtcgaccactccgccgacctcgtctacgcgggccagtccggcgccatgaacgaggcgatcgcggactacttcggcaacgccatcgagacggatgtgcacggcatagccatggccgacccggactcggggctgctgggtgaggcgctctgccggaccaggacgccgcgcgagtgcgcggtccgcgacctgaacgacgggcggaccaccgccaagtccttcctcggtgtggggttcggcaccgacaacggcggtgtccacctcaactccacgatcttctccggtgcgttgtgggacatccgcgaggacgtcggccccactctcgccgacaagatcgtgtacaaggcgctcacggagtacctcaccccgctcgacggcttcacccaggggcgggacgcggtgatcgccgccgccagggctctggggaccggcggcaaggacctcacggccgtccagcgggccttcaacgcccatggcatcgtgcccaactgggagctggcgctgggcgtcgactccgacctgctgatcgagcgcgtcaacacctacgactcccaactgggcgcgggcggcgactggtggacggccgccacgtccaacgaggagggctccgaggcgtactcggtgtgggccgggcgcacggacggcacgggccagctgaaactgatgagccccaacgacggccgctaccacgtgaatccggccacggacggcaagaccgtggtgtggcaggcgcacgggacctccggcgtggacatcctcgcccggcccctcgcgggcggcccggtgaagacgttgtggcacggccggagtgtgggcggcgcgctggacgtcgacggtgacgtggtggccttcgcgtacaacaaccacggcggaagagccggcgtggcctacctgagtctgaaggacccggcgaacgtggtcacgatcggtgggggcacgtaccaccgggcgaccttcccgtcgctgagccacggcaaggtcgtctaccaggaccggcagcgggtgagcgccgtgtacgagaccaccacccgggtggtcgatgtggcgaccggtgaggacaaggtgatccagcgggccgccccgggggcgagcctcggcccgacggccgtcaccggcgatcacgtctactggctgctcgacgagatcgatcagaacggcacgacggccctgcgccgtgccgggctcgacggctcgggcatcacggacctcagcccggagaccggcccggagtccctgaacgtcttcgatctgacggcctccgagggggcggtgacagtggacgcccggacgccggaccccgcgttccgcaacgagtcgctggccaagctctggcagttctcagcggagggcaagggcgatggcgtacgcaagagccgggtctcctgcaaccggggtgagcagctgtcggccgccgcggcatccggcacccaagtggtgtggctcgacgcgacgaccggcatcagcaatgtggtgacccggacccggccgagcggtacgtgcggctgacggattcggaaggggtcggcggcttaccggacaggtgtccggcaagccgccgaaacaacgcgcggccgcacatcggggctacccctcgcgtagcgcggcaccggtccgaccgcacttggtgaacgtgcgcccggctcaaacacgcatgcccgccggcctgatggcggcgtccgcgggcgctcaggtaccggcgggcttgcccgggccggggacgttgcggaagcggaacggctccggttcgcggtcggcctggacgaaccagcactcccccgtgccgtcgccggtgacgatccgcagcaccgtgtccgccacggcctgagccgggatgaccggcagtccctgctcggcgagcatgtcacgcaggtcgtcgatgatccgtgactcggcgtaccccgggcagaccgcgttgaagcgcacgttctccggcgcgagagcctgccccagggagcgtgcgaggcccactaccgcatgcttgttggccgcgtacaggggatcgagcggtaccgccgccagaccggccagggacgcggtcgccacgatcgaccctccgccgcgggctcgcagcgccggcagcaccgcgtgggtgccgaagaccacaccgtcgaggttggcgcccatcgcccggcggtagcgggccaggtcgaagtcctcgccgacgccgcatccggtcgtcacgcccgcgttgaggaacgcgatgtcgacgccgccgtactgctcctgggcgaagtccaccagcgcgcggttggcgtcgaggtcggagacgtcacaggcgcggaagtggccgccgaccaggtcggccacctccttgccgccctgcgggtcgaggtccgcgacgaccacccgggcccccgccttcccgagcgccagcgccgtggcccggcccagtccgccggcaccgccggtgacgatcgccaccttgccctggagcgtggcgccgtccgtctgttctctccgcgcgacggcggtcccgcccttgacggtcatgccagctccagcacgagcttgccgacgttctcgctgcggaagagcatctgcaaggtctcggggaagtcgtccacggtccccctcaccacatgctccttgaccttgatgtggccggcgccgatccagccggagatctcctgcgtggcctgcgggtagcgcttggcgtagtcgaagacgacgaggccctccatgcgggcgcggcgcaccagcagcgagaggtagttcgaggggcccttgaccggtgtggcgttgttgtactgactgatcgcgccgcagaccacgacgcgcgcgtgcatcgccagccgggtcagggcggcgtcgaggatgtcccctccgacgttgtcgaagtagacgtcgatgccgtcgggggcatgcccgcgcagtgctttcctgacatcctcggtgcggtagtcgatcgccgcgtcgaatcccagctcgtcggtgagcagggcgcacttctccggccctccggcgatgcccacgacccggcagcccttggccttcgcgatctgacccaccatgctgccgaccgcgccggccgcccccgacaccacgacggtctcgccgtccttcagcgccccgacctccagcaggccgaagtaggcggtcatgccgggcatgcccagcgcccccagatacgtcgagggcggggcgagggaggtgtcgatcttcatggcgcccttgccgtcggagaccacgtgctcctggacgccgaacgtgccgaccacgtgatcaccgggctggaagtcggggtggttggacgcggtgacctcgatgaccgacccggcgcgcatcacctcgccgatgcccacgggcggcaggtaggaggggcggtcgtccagccagccccgcatggccggatccagggagatgacacgcgtccggcccgcgaaccggcccggacccggttcctcgacgggcccggaacaatgctcccagtcgtcgggcttcacctcacccacggggcgggctgccagacggatctgacgattggtcgcagacatcgtgcctcctgttgttcgcgcggtcccccgcgaccataccgaccagtaggtacgaagaggcctgtgatgtacaccacatgccatgggtgactccgccctcgacccctgagagtcaccgcgaggacggcccggacgggcacgggaatcgacgccgaagatccggcatgactgcccggaagtcctcaacctccctttccctctcgcggagttcaccgacggccccacagggccaccggcccggtccgcggcccgtcggccttcgaccgtcaggcgatcaccgccggccggataccgcatcgagccggaaacgtaacgcacggcgggcttaccagccatactgaccagtcggtaccgtgcgccgccgtgcccatttcttccccgctcacctccacggatccgagccgcactggaaggccacgcgatgacacacgccgacgacaaccggtacccgccagcagcaccaccgggatggccgcagccgcggaccgcgccccatgagaacgcccctcggcacgagccgtacggatatgacgcccctcggcacgactcgtacggatacgacacccctcgccgcgactcgtacggatacgacgcctctccgtacgacccgtacgggcaagcccctcggcaccggccgtccacgcacgagccccatcggcaccatgccgacctcgccgccctccgctcggcctaccgcgtgctccgccgggtgtccactctcaccgcgctcggctccttcgtggtgtacgtggtgctctcctgctacgcgccggacctgatggggtccaagatcgccggggagctgagcctgggcatggccctgggggtcctccagctcatcgtcaccttcgcggcggtcctctggtacggacgcagcgcacaacgttccgtggacccgctggcgcgggtggtcagggagcgggcggtccggccgggccgggacgccgaggtggcgagatgaacgacttcagctccgggacgcaggcgaccgtcctgatcctgttcaccgccctggtcaccctcacgctgctgatgtgcgtgatggcgggaccggaccgcgacgacctgacgaacttctacaccggctacctctcgctcaccccgctcaagaacggcctggcgatcgcgggcgactacatttccgcggccacggtgctgagcaccaccggcatcatcgcgctcgccggatacgacggcgacgtgctggcggtcagcaccgccatgtcgctggtgctgctgatgttcctgctggccgaacccctgcgcaacgccggcaggttcaccatgggagacgtcctggcccgcaacatgcccgggcgggccgtccgtatcgcctcctgcgtggtgacgctcgcggcgaccctccccttcctggtcgtccagctctccggggccgggtcgctgctcaccttcatcctgggcatcccgcacctgtcgggcgccagaacggtgtgcatcgtcctcgtcggcagcttgatgatcatttacgcggcgatcggcggcatgcgcggcaccgcactcatccagatgatcaagatcgtgcttctgctgggcaccagcgtcgccctcgccgccctggtcctgaaccgcttcgactggaaccccggcgacctgctccgggccgcccagcgcggcagcggcgcgggcccggccttcctccagcagggcctgcaactgggcacctcggccggcagccggctggacttcgtcagtctccagatcaccgtggtactcggcgtggcctgcctgccgcacatcacgatgcgcctgttctccgcgcgggacgtgcccgccgtgcgccgctccatgtcgtgggcggtcggcacggtcaccacgttctgcctgctcgtgatcgtcatgggcacgggcgcggcggcgctcgtgggatcgcggtacatcaccgcggccgacccgcacggcaggacgtccgtgctcatgctgtcccaggtgctcggcggcgatgccgactccgcgggggcgacgatcctctacgcggccatggcgggcacggtgttcatcaccctgctgtcctcggtcgcggggatgaccctggccgcggcctcgtcactcgcccacgacctgttcgcccatgcggcgcggcggggacaggcggcgccgcgcacggagatgacggtcgcggcgtggacgagcgtggctgtgggaaccgtcgccatcacgctctccaccctggtccagcactgggacgtcggcgtactgaccacgctggcgatctgcatcggggcgtcggcggtggcccccgcgctgacgtactccctgttctggcgaggcttcacgcgcaccggcctgctcgggagcctctacggcggcgcggcctgcgcgctggtgctgatggtcttctcccaggccgtttcgggtacgccgtccgccgtgttcccgaaggccgacttcgctctgttcccgatgcagtcgaccggcctggtctccataccgttcggctacctggcgggctggctgggcagccgtctcgaccgccggcgccgcgccgccgagagccgcgagaaccagcggctgtacgaggagagcgaggcacggctgctcgccgccgccgaatgaccgcgtcttcgggggcacgccactcctgggggcttcggcccccagggcggccgcccccgaccgcgactcctgtgagctgcctcacccgtcgctgtcggttcgcgcatacgaaccgcctggtcagcgccactctgcacattcgacggaccgcgcgttggccggatacgtcactaatctgtcattgcagccagtgcgactcccgatacaggctgtgaccgtgctagagcgacgtgttgttgtggtggtgtatgcgggcgcgctggccctggacatcaccggaccgattgaagtgttcgataccgccaaccggctccttcctcccgcgggtgccccctaccggatcgacttggtgtcccccgacgcaccactggtgcgcacgagttcgggagtgagggtggaggcctctccgctggacgcggggcagggcccgatcgacacgctcctcgtgccgggcggatggagtctcgacaacgcgctccgggaccgggcgctggtctcctggatcggccgggcagcggcccggtcgcaccgagtcgcctccgtatgcggcggatcctttctgctggccgaggcgggtctgctcgacggcagacgcgccaccacgcactgggcatacagcgaggcgatggcctgccgctacccggacgtgacggtggacgccgagccgatcttcgtctgggacggccccttcgtgacgtcagcgggcgtgtcgaccgggatcgacatggcgctggccctggtcgaggccgatcacggagcggcgctcgcgctggagacggcgcggtttctggtgctgttcctcaagcggcacggaggacagtcccagttcagcgccatcctcgacgcccagttggccgaccatccgccgatccggaccgcacaggagtggatcctggacaacctgcacaaccccttacccgtggccgagatcgcgaggcgggccaacatgagcctgcgcaacttcgcccgggtcttcagacgcgaggtgggcacgaccccgggccagtacgtcgagcggacgcggatcgcccgcgcacgcgagctgctggaaaccaccgatctgacgatcggccagatagcgggccgctgcggattcgccgcccccgagaccttcttccgctccttcggacgcaccctgggactcaccccgaaggagtaccggcaccgctttcaggtcatctcgccatccggcctcatcgaccggcaccacgagacggacaggagccccgcatgaccacccccacctcggacatacgctcgggcataccctcggacttacccgaggcaggaacggtacgcctggtcgaccacctggccggggaactcgccagggcgggcgtcacccacatgttcggcgtcggcggcgcgaacatcgaggacctgtacgacgccgttcaccgcggccgcgccgtccacggcgtcgtcgccaaacacgagttctccgccgtcacgatggccgacggatacgcccgaaccaccgggcgcctcggtgtggtcgccgccacctcgggcggtggcgcgatgaatctcgtaccgggcctggcggaggcgtacgcctcccgggtacccgtgctggccctggtcgggcagccgccgaccggccaggaaggccacggggcgttccaggactccagcggcagggcgggctccttcgacgcccgggaggtcttcaccccggtctcccggttctgtgcccgggtcgagaacgccgactcgctcacggagttactgccccgggcgatggcggcggcacaggcccatccgcgaggtcctgcggtgctgctgctgcccaaggacgtgcagcaggcacggatccaggtgcccggtcgcggcgcgacgccgacaccaggcatgccggagccggagccgacggcagaggcggcgtggctcgactccgcggtcctcaccgccgtgtcggacaccctgcgcggggccggccgcgtcctcgtcatcgccggtgaagacgtggccgccgcggacgcgcgggcggagctggccgaactggccggacgtctcggggcgtgggtggcggtcacccccgacgccaaggatgtcttcgacaaccgtgatccccggttcgcaggtgtggccggggtgatgggccatgccaacgtcgaggagtgtctgcggcgggccgacgtgtgcctgctggccggtacccggctgccgctcctggcacgcggcggcctcgaccgggccctggccgccaccgaggtcgtgtgcctcggtcccgaaccgccgttcgtggcgggcaccgcactgggcgggaacctgcgggacgcgctgcgcgcggtgaccggccggctcccgccgcgcccacgtgcctgcccggagcacgccggtccgctccccacccccacgccgagcccggtttctcaggcccgtgggcgacccatcccctatgcccaggcggtcgccgcggtggaggcggccctcccccaggacgcgcacgtcttcgtggacgccggcaacgcgggggccagcgcggtccatctcctgccggctccgcgccacggccgcttcgtggtggcggtcggcatgggcggcatgggctacaccttcggcgcggggatcggcgccgcgctcgccaccggccgacgcacctacgtactcgccggcgacgggtccttcttcatgcacgggatggaagtgcacacggccgtggagtacgccgcacccgtgaccttcgtcgtcttcaacaacaacgcccacgccatgtgcgcggtgcgtgaggagttcctccagggcggcgtccgcagcgacgacctgttcgcccggaccgacctcgccgccggggtggccgccgccttcccgtccctggaggtcacgggggccgacgacgctgcgcagctgcgtcaggcgctgctgcgcagcaatgcgggcggcggcccggcgttcgtcgcactggactgcgacccgggggagatccccccgttccttcccttccagtccttcaccgaagccaccgagaacgccaccgagaacaaggagagcccagttgaacgaggaatcgtccacgttggctgacatccccggtctgatgcggatcgagaatcccggcaaggaggagctgaccgcccactgcatggagctcactcacgccgtctacccccaccatcaggtctacgggcagtactgcaccatccacgcgtacgtcgactgcccaccggagcgggcctacgactacctgcgccagggccaccacctggaggagtggacctgcagcctgcgggacttcgcgcccgccggcccaccgggactgtgggtcggccacgaccggctcgaggacgacaccaggatctactgcgaggtggtcgccaaccccgaggccatgaccgtggactaccactgctcctgggaccagggcgagaagctgtggatgatctacctgatgcgcgtcgtaccggcccgcctggtgctcgacaagccggggtcggtgatcacctggaccaactgccggcacccctactacgacgacaacccgcaccccggcgcggctccccgcccggaccggccctgggtgggcgactactgggatctcttctacgcggggcacaccgtggagatgaacaacctcaaggcgatcctggaacaccgccaccgcaacggactgcccgtcaacgtggctccgccgacggcggtggcgcggtgaccacggtcagcctcaccgacgtcgcgagctaccttcccggcgagccggtccccgcggagttctacaccgactaccccggagccgaggacaagctccgcaaccaccccatgttcaaggtcccgccgtcgcggcaccacgtggccgcggacgagtccaacgcggacatggtcgagcgcgccgtacagcctctgatcgagcggcacggcagggacgagatccgtggcgtcgacgtgctgttggtgcacagccagctgccggacctgccgttcgtgggcgccggcaccgaggtggcacgccggttgggcctgaacccggagtggctcgtcgacgtggccaacgcgggctgcgcgtccttcgtgtacatgctgaagctggcccggcagatcctcacgaccaccgacgcgaagacggcgctgatctgcaacgcgcagagcgccgcgggccagtgcttcacccagtccgaggtgcgcaggctcgcccaggccgcgatcccgggcgacggctgcggtgtggggtatgtgacgacgtcggccgacaccccggtccttgacgtggagacccggcacatcggcgagtacgccggggacatgaccgtggcggtcgacgacggccgcaagtactgggaaccgggagagtcccagctgcggatcgggttcaccgacgccagcgtcgccaaggtcctggcacgcgggaaccgtctggtaccggaggtggtcacggacctgtgccgacggctcggcgtggcgaccgccgacatcgacgtcctcatcaccaaccagcccaaccgcacgttcctgcggaactggcgggaggcgctgcaactgccgcccgaacggcatctgaacaccttcgatcagtacgggaatctgttcggagcggcgatcccgatcaccctggaccgcgcgatccgctcacggcaggtcgaggacggcgacctggtggtgctgggaggtttcgcccacgcgggcgacttcgccggtgcgaccgccgtccgctggcacggcgggcggggatgaccgatggacgtcccggtgctgcaccgactggccctgaacgaaagcccgtaccccccgctgccctcggtccgcaaggcgatgcgacgggccgtcgcacaggcccaccggtacccgcagttctaccccgacgacctcaccgaactgatcgccgcgtggtgccgggtgacccccgaccgcgtcgtggtcggcagcggatcggtgggcgtcgcactccagttgctccaggcggtcgtcgagcacggcgacacgatggcctacgcctggcgtaccttcgacgcgtatcccctgctggccgccatggtcggcgctcatcccgttcccgtacccctgtcgccggacggacaacaggatctgggcgccctgctcgcggcgctcgaccaccgcacccgtgtcgtggtgctgtgcaatccgcacaaccccaccggaagcctggtcaccgcggacgatctgtcggcgttcctgcgtcaggtccccccacgcgtcaccgtgctcctcgacgaggcgtacgtggagttcgcccgcggtcccggcctgccggacacacccgcgctcctgggcgcgcaccccaacctgctggtcctgcgcaccttctccaaggcctacggcctcgtcgccctgcgggtcggttacggactcggcgcccccgacctggtggcgcggatccgccggcaacagctgcccttcgggatcaacgcggtggcgacggcggcggtgcgggcctcgctgcgggccgacggcgagctgcgcctacgtgtggacaccgtcgtcgccgaacgcgaacggctccggcacgaactcgtcgacctcggctggcgcgttcgcccgggccacgccaactctgcctggctcgacgcgccggatccgatcgacgagggcgccgcggcactcaccgccgccggtgtccaggcgcgccactaccccggcgagggactccggctcaccgtcggcagccgcaaggcgaacgacgccgtgctcgccgcgctggcgggagtcggccgacacacggcgtccggcaggcgcgcctcgtccgcagcacccgacgggacggtcgccgcccatcggcgaccgccggtgagcgggcagcggccggacggatgaacgacggcgcgggcgaccggccggggcagtcgtacgccgctggagggtggcgagtgcgtgacggactcgccacgcacgtgccgcctcgccggtcgccgggtctgctgcgcagcggctccgccttcccgcacctggcccggcgcctctcctggcatccctgaaccgcggccggaccggcaggacgggcccgtcgggctccgcgtcacgagcggagcccgacgcggactccggcggcatccggagcagggaggtcgccgtctcagaaggcggagttggcgaaccagtgggccaggaggccctcgtccccctcgtgcgcgagggcctccgcgtcgtagggcaggcggccgtatgcgaggaggagcaagtcggtcgcggttccccggacggtcgcggcagcggtgtcctcggtcgggtgggtcgtgtcgagcccgaagccgtcgggccgcagacggacgagccagtcgtcgtccccgtcggtggcgcggaagcggatggtcctgtcggggccgcgcaggttggccaccttgggggcgaagaaggcggcgaagggcaggttgacgaggaactcatcgatcccgtcgaccgcgagcgggcggtcgatcgtgggccgcaggccgagcgccagctcggcgtcggcccggtgcagcagggtctcgaagagcatccggcgggcccagaagcgggcgtgctggtcgacgccccacgcccacatcggcaggttcgggtcggtggccgcgaaggcttccgcggccacggtcgcgctctcggccagccagtcggcgtatccgccctcctcgtcagggaaccgcaggtccacttcacgcttttgcgggggttcctggatgcgcgcccgcaacagcaccgagaaccaccgctggacgctgcctgtgtgcttgacgaggtcggccagcgtccagccggggcaaccgggtaccgctgtcgccaggtcggcgtccttgaccactgcgacgaatcgggcggtctccgccgcgaccgccgtgcgatggtcgaccggggcgaaaccggatccgtggtcggggtggtccgagatcttcatcgtggcatgcctttcggagcaggtgcgggttcagccgagcggccggctgaggatggtgtgggagtggctggccatgtcgagggaggtgtccgccggatcaccggcccgcacgccgacaccgccgaacgggagctcagggacgggttgcacgagaacgagcggcgaggacggctcactgacggctccgatgccgcctccgcgcactctctcaccagcggacgagtacgcgccgccggtcccggccgggccgggccgtgggcagggaacccgatcacacgagttcggcgtcggcttccacctctgcggactgcggcgtcccggactgcgtgaccttcctcagcacgggcgtacgaggcgcatgcgccgccttgagtccgaccagggcgactgccaccaccaggacgaacgccgctccggcgatggtgaagctcaacgtgaactggctctcctgcggcagcgcgggcatcccgtccggaagcgggatggtcttcgacgccagcagcgaggtgatcaccgcgctcgcgacggcgctgccgaccgagcgggagatggagttgatgccgttggcgatgccggtctggtgggccgggacgctggccacgatgagcgcgggcatggaggcgtaaccgaagctgatcgccagtccgatgaccatgcccgcgccgatcaccgaggcagtggcgtcgtgcgcggcgctcagccacgtgaagccgagcactccgaagcaggccccggcagccagcgtgacgcgggcgccgagccggcgcaccaggacgccgccgaactgagcgcccacgagcgaaacgagtgtggtcggcagcagatacacgacggacgccgccagcacggaagcgccgaagccgtagccggcgacgtcttcgggcatctggacgaggtacgagacgccgatgaactgggtgaacatcgcgaagcccagcagcagtccggccaggttggtgaagaggacgggccgatgggcgaacatccgcatgtcgaccatcggttccttgacccggctctcggtgatgacccacaccaccgccatgacgatcgccccgacgaacgcgccgagcgtacggccggacgtccatccccactcgtgcccctgcgagatgggcagaagcagcagcaccagcaacatcgccagggtgaacgcacccagccagtccgtccggccgcccgtcttcgtccgggaagcgggcacggcgaacagcacacctgccaacgccatcaccgcgagcgccaccgcgagccagaagacccggtggtagtcggggtcggagccctgggtgaggagccccgcgccgaccagcgcgagtccgctgccgaacgcgagtgtgccactgaccagggccatggccccgtgcaacttctccggcttgatctcttcgcgcaggacggagagggcgagcgggaagatcgcggtcgccgctccctgcatcacgcggccgacgatcagccaggtcagcgaggtggtggtggcggcgagcaccgaaccggcgatcatcacgagcagaacgccgacgagggtgggcttcttgccgtgctggtcgccgaagcggccgagcagcggggtgaacacggcggccgacaggagcgtggccgtggtcacccagctgacgtttgccgtggtgacctccaggtcgctctggatgatgcccaggaccgggacgaccagggtctgcatcatcgagacgaccatggcggcaagcccgagcgccaggacgaccacggtgtctcctgagtgtcgtcggggcaccgcgtgctgtgcgtgagacacggaaagtcttccctacttgcgaacgtggatgaactacttgacaacctcgatgcttgagaacttcaagcaatggcggcaccgtaaccaccaatacttgagatcgtcaaatattctggcgtaggctgagccgcatgacaggaaccccccgcatcgacacggcccagctcatggagctgctctcggtgtcgctggctgcctactacggcgacttcacggtcgccgccgcgagcgaaagcctcacggccagccagggcaagacgctgaacgtgctgcgtcggggacccgcgtccatgagcgtcctggccaccacgctgacctgcgacgcctccaacatgaccgggatcgtcgaccggctggagaagcgcggtctggtgcgccgcgagcccagcccttccgatcggcgcgtcaagaacgtcatcctcaccgccgagggcgagcgggtcatcgacgtgatccgcgggaagatgcacgccacgctcgccggcctgaacagactcagcgcgcaggagcgggacaccctgtacgcgctgctggagcgtgctttcaccgcacagctcgctgccgcctgactctgtcgccgcccaccgacgggggctcgcggggcgatcggatccaccacggggcacgggcacggggcacggggcacgggcacgggtgcctcgggtgcaggtagtccggattgcaccgggacagctccgcggccgaacttgccgaggtagcccacgaggcacggaggctgaccgcgtcggaggacgccgcaggacccaccccccgtgggtgcccgggctgaccgacggcccgtgggcgagcaggtcgtcgacaccacctgccggtacgccgagtacgacccggtcacccgtcggcagcccccaccagcacggttgagctacgccgacgccgaggtttcgagtcgactgctcaccgccccggcgtcgattccgacgatgtccgcgctaaaggccgatgccggctccttccctgaacgggagcgcgtcaccgaggagctgcccgccgtcgatcaccatcgtctcgccggtgatccaactcgcggcgtccgagacgagaaaggcgaccgccgaggcgatgtcggcaggctcccctatgcgcccgagtgccgtcgcggcggacacggcctgctcgtgctccttccacagagactcggccagcttcgtgcgcaccacacccggcgccaccgcgttgacgcgaaccttcggcgagagttccagggccagttgcttcgtgaggtggatcagcgcggccttcgacgcgttgtacaacccgatgttcgcctcgaaggccatgccgcccaccgacgcggtgttgacgatcgcgccgccgtgctcgcccatccaggcccgcgtggccaaacccgtccacaggacgggagcccacaggttcacgtcgaaggtcttggcgaaccggccgtggtcctggtcgatgacgggcccgaaagccgggttggttcccgcgttgttgacgaggatgtccaggctcccgaagcgctcgagcgtcagatcgacacagcgccgggccgcttcctcgtcgaccgcgtgcgcaccgacgcccaccgccgtgcccccgacccgggccgcggcggcgtcagccgcctcctgggaccgggaggtgaggacgacgtttccgccggcggcggcgatggcctgcgcgatcgccagcccgataccgcgcgaggcgcccgtgacgacggcggtgcgaccggtgagatccagtcctgccatgtcagctcaccactgccttgtgaccgccgggggtgaccgtgccgccggccgccccggcggcgtcgcggtaccggcccagttcatgcctggcgatggctcgcttgtggacctcgtcgggaccgtccgcgagccgcagtgtccgcagctgcgcgtacatcatcgccagcgggaagtcctcgctcacgcccgccgctccgtgcacctggatcgcgcggtcgatgatcttcaacgcgatgttcggggcggccaccttgatggccgcgatctcggtgcgcgcccccttgttcccgaccgtgtccatcagatacgcggccttgaacgtgagcaggcggatcatctcgatgtcgatacgcgcttccgcgatccagtcctggatgttggaccgctcggcgaccggactgccgaatgtcacccgtgactgcgcgcgtcggcacatcagctccagcgcccgctcggccgcgccgatggcccgcatgcagtggtggatacgaccgggcccgagccgggcctggctgatcgcgaagccctctccctcgcccttgaggacgtccttggccggcacccgtacgtcggtgaagtcgatttcggcgtgcccctcacggtcctggtagccgaacaccagcaggccgcgcatcaccgtgaccccgggggcgtcgatcgggacgaccatcatcgactgctggcggtgcggatcagcggtggggtccgtcttccccatgacgatgagcactttgcagttgcggtgcagggcgttggacgcgaaccacttgcggccgttgagtacgtactcgtcgccgtcgcgctccatccgcaactcgatgttggtggcgtcggagctggcgacacgcggctcggtcatcgcgaaggccgaggccatcgtcccgtcgagcaggggcttgaggtacttctccttgtgctcgtcgctgccgaacagcgtgagcacctccatgttgccggtgtcgggagcattgcagttgcacgcttcggaggcgatgtggctgcgccccatgatctccgccagcggcgcgtattcgaggttcgtcagcccggggccccattccgggtgcgggtggaagaggttccacagtccgcgtccccgcgcctccgccttgagctcctcgatgaccggggggtggaagtgcgggtcacccgaagcgctcatctgctcgtggtacaccgcctcagcggggtagacatgcgaatccatgaactcgagcagttccgcctggtatttcttggcgcggtccgacatctcgaacagggacatctgaactcctgacaggtagggagcgaaaggtcggcggccacttgtcgaggtgactggccatgccctcgacgacaccggaccccgcggaaggcctgggcgtgacgcctgccgcccgggccacggaatcgggcgggccgggccgggccggggcatggcccggagatggatggtgtgaccgtgctctgtcccctgtataattgaatctgacgtcaagttcaatagctgggctcgcggcaccgcccggagaaggccgcgtggcctctactgaactgcggacggggacatgccgatggcaccgccgggatcaccgaacggatcatcaaggaactcggttccaggaaacggccatgcgcccgctggccgtgccgatgcggcgccagggccgccgtacggccgtgagcggcaggcttcgttccgggtcaggctgcgggccagactgctggatcagccgtggccggggaaccgcagggcgttcgcccagagccgggtgaccgtggacacgagctcctcgaagtccaccggcgcatcttcctcgtgccgttcgccgagcacgaaggcgttgtaggccatgacgctgaccatgcccgacagcgcacgggaggccatcagcggatcgaccccacggtctgcgacaccccgtgcctgaaggtcagcgatgccgcgcgcattgcggcggatgaacgcgtcagcgcgccggctccggaacgtacggaactccggctccacctgtgcgacctgctcgagcagcgccatcagcttcgcattccgtttgtacgcctcgagatacgcgcgattgctcgcctcgagtaccgcatagggatcgtcgctaccctgcacccggctcatgccggggtgcatcatgtcctcctgcgcctccaggaggacggcggcaagcacctcttccttgttggtgaagtaggtgtaaaaggatcccgccgcgcattgcgcctctttggtgatgtcggtcaggcgggtgtcgaggtagccgtcccgttcgaacaccttccgcgcggccttcaccagagcggcccgggtccgcgctccgcgcttcgtcgtaggcggctcgcgaaggtgcgagaggggcgccacgggcggtaccttctcgccgtcgatctcctcgggcccagtggtgtccatcctggaaactctacttgaatccgacgtcatcgtcataaacctgcgaggcgtgcggggcccaccggcggcgccggtggatgtcccgccgtagcggtcgaccggtcaggcggtgatcccgaagcgttcggcgagttggcggcgggtgtcggcggcgctggtgtgcaggacgcccccgattccgatccgtgccgctccgtcgaggttctgccgcagatcgtcgatcatgaccgcctcctcggggtcgatgccgaggcgttcacatgcgatcgcgtagatccgccgggagggcttacggatcccgacctcggcggagatgacgaccacatcggcaacagcggcgaggtcgacgccgtcgtaggttccggtaccgaacgaattggatacgagagcaaccggatggccggcggctcgaagaccaccgagcagcgcgagcatgtcctggtcgatcgacattcccgcttgcatccgggccgtcagcccctcggccggtacgtcggcgccgtggacgcggagacgttcggcgaatcctcgctcaaaggcttcggcgtcgatacggccgcactcgtggtcggccagaagggtgcgtgacggctggtcccggccgaggaggtccagcggcaggcgcgggtcgccgccgagcgaggcaccgaagtcggtgaaagcccgcaacacactggaggtgatgaccccgccgaagtccaccaggaccgcggttcgggtcttttccgccacgttcgacaccgtattcacgcctctcgctcggtctgcctaccgtcggaccatgcgacggcagccatgtttcgtaggcactcatgaagtgcccgtggtaccccgcacccggccggtcctcgccgcccctgtccagcgaggacgccgagctcagacgacctcgaacagtccggccgcgcccatgccgccgccgacgcacatcgagaccaccacataccggacacctcggcgcttgccctcgatgagggcatgccccaccagccgggcaccggtcattccgtacggatgaccgaccgagatcgcgccgccgtcgacgttgaaccgctccgggtcgatatgcagttcgtcacggcagtacaacgcctgggaagcgaacgcctcgttgagttcccacaggccgatgtcgtccatggtgaggtcgtgctgcttcagcagtttcggaatggcgaacaccggaccgatgcccatctcgtccggcccacaaccggcaacggtcataccccggtagacgcccagcggttccagtccgcggcgctcggcctccttcgactccatcagtaccgacgccgaagccccgtccgacaactgcgaggagttgcccgccgtcacgctggaatgcgcgctcacctgaccgtccggaagcaccggcgccagcccggccagaccttcgagcgtcgtcgacgcgcggttgccctcgtcccgggtcagggtgacctcctcgtcccgcacctcgccggtctgcttgtcgaggaccttcttgacgctgccgagcgccacgatctcgcggtcgaaccggccggcctcctgcgccgccgcggtgcgctgctgtgacaccagcgcgaactcgtcctggcgttcccggctcacgccgtaacgttcggcgacgatctccgccgtctgcaacatcggcatgtagatactcggcttgtgctcgaccagccagggatccgccatgcggtgggtgttcatgcggtcgttctgcaccaaggagatcgactcgacaccgccgccgacagcgacctgcatgccgtccgtgacaatctgcttggcggccgtcgcaatggccatcaggcccgacgagcactgccggtcgaccgtcatgcccgacacggtgtccggaagtccggcacggagagcggcctgacgcgccacgttgccaccggaggatccctgctgcacggcgcagccgaagatcacatcctcgacctcacctccctcgagcccggcgcgccgcaccgcgtgcgaaagggcatgggcggcaagttcctgcgcctgggtgtcgttgaacgcgccccggtaggcctttccgatcggcgtccgtgccgtcgaaacgatgactgcttccctcatgtcgcctcactgtttcctgttggcccggttcgtccgggagcttcggggccaagactccgagctccgtgagccgggctcgatgccggtaggcggtgtcgaacgccaactgcggcgcggcgaaggctccttgaccgtctcctccggcgaccgacgccatgagccatggccgcaggggtgacgggagtcggccttccggttggttatagttgaattcggcgtcatgttcaaccgagcgggcccttgggtgatcaggaagacatggggtcacgggtccgacagcaaggcgaccaaaagcccggcgcccggccgccattgccggggtgggcatgctcgcggtcttggcagccgcctgcccctggagaccggctgacagggcctcgcgcttgatctgctcgatctgctcgatctgctcgacacgggtggccgttgcttgcgggaggagtgtccgccggcggcggacactcctcccgcgaggcggcagccctgacgctgtttcaccacggcgacggccgctgctgccgcaacagcgcggcaacggcgactgccccggcgtgcgcggcgagcaccgacacactgggtcggcgccggccggagtggaagacaggaccggaccgagtgaaacgccgatgcccctctcgacgacgtgcgtcggtacggctcctgccggccaccacctggctgtcgcgcgcccctggccgccctgcgggccgatgggcggcggcgcggggccccctggacccacgcggcggcggggcgcgaccgcgacagctcagcccagcagctcagcgctgccggccggttcgcgccgctcttgtccgttgatgcggtgccgttcgatggacgaacgccggtacacctcctgccgcacccgctgaatctcgccgatgggccggtgttcctggcgtgatcgccacggcgtgatcgacgtggcgtcggcggccgccaggttgtcgttcccgccgatgtcctggcgcgggatgtccacccgggcgaccgtcccccagggggacagatcctcgggccacctgacggacgtgttgtccaccggcatacgggccagatcggtgttgagctggacctggagctcgaaggagtggtctcgctcggcggcctcggccaccagggtgcgccggaacgcctcgttgtccgcgcgcacgtccacgatctggtgcgtgagggaggccagggacgcggcggtcggcacggtacggatcttggcgatgtggtcgccgtaccggaaggcgcccatgctgttgtagctgtacgacagcaggttcctgcgcgggacactggtgaacgacagcatggcgagcagttcgtcccacagccagctgccgggatcggtgagcgtctgccggcgggtcaggaactccgccatccaggtcttgcggcgggccgggtccacgagcgcctcgggcaattcggcgaacagctcctcgatcaccatatagtcgtaggccgtgttcgcgaagaagacatcgttgttgatcaggttgaggtcgaaggtgccgctgtctcgttcgtcgtccagcagcgaggggccgtcgactccgaacagcttgatgcccattccgcacgccgcgcccagctggtggtcggggcggaagtggcccaagccgttcgagtagcggacgacggcgtcgtacgcggtcgggcgggcgaagattccctgcccgtagacgccggggttgtcaccaatcgtgaccgtggccttgaggaggccgtaggtctttccgtgggcggtgcggacagcgcggccgacggtctcgcgctcgaccgaggcgcgcgtacgacgcgccacctgggcgacgactgcttccatctcctcctggtaggacgggcgttcggtgggccggtagtcctcgtagcggacgggattcatggtgccgcctctctgtcgtggtgcactgctcacagacgctagtacgcaatttgattgtgcacaacgtaactgtgcgccatcacacgctcccggtaccgacgtcggtgcttcgatcgatccggcggcctgggtgatcgatgatgtgccggtgcccaaaggcggccggatgtcggccggggtggcccttcagggctgcggggcattgggcgaacccccacgcgcacctgcggaccgcgctgtccgagcgcggacttgactacgtcctggccgtcgggtcggaggtgagcgcgcatcccttcgaggcggagcccgtggccccggctcgcaatgaggccatcggctgccggcctcagccccgccggcggcaccccgcaccgtcggtggcggccctggccgcaggcctcggccaggaggcattcaccccgtcacgcggcggcacggctcaagcggggagtcgtgctcccgcttcgccgccgtgcgtgtgcgccccgccggcaaagcagtcgagcgcagcagtgactcagccaccggcttgccttctgccgctcggtgagccactgctggtgggagaggcgctgatgctgccggaaggactggcggagggactcgcggaaggggtcgccgtctgcgagggcgagctggggcggccactggaggttcgggagggcggcttcgccttcactggtggcggcgcaacggtggtggcggcgggaggccgggagaccggtgactcgctgcgagttgccgtcggcagaggacgccggctcccgtcaacgtttcggtcccggacgccctttcggcccgggtgcgtggtcacacgctccgatgaagccggtgcgtcggtgccgcggactcccagctcttcgggggatgactgatccgggatcgaggctgctcgtggggctgtcggctgggaaagcaccgatgcggtggtcagacctccgaggatggtgaaggcggctgcggcgaaagaccggacggcgtacttcttcagccgcgacggacggtcgtacccgtctgccggcaggtctggcccgggagttggtgacccggcaaggggagacgcggaggagctcggtcccccactgaagcggacctccggcatcacggcgtctgcggccggagcagcgtctctccgatcgctcagctgtgccatgccggggtcgtatgccccgcactccgggcaggttacggcgccgttgagcgtgcggctgcacgggaggcagtagtccatgatgcgatcgatctcagcccttgagttgacgggaggaaaggtgcacccgagccgggcagcagtcagcggcggggagacaccgctcggtttgttccggaccgatctttaacatgtgcgaacctcccttaccggtctgccggcgggtcgccggttactggggtcaacggggcggatcgaaagagtgctcagccgccacccgaaaagtggggtacataactctgctggaagaaccgttgatgacccgaacgtcgcggcaccctcggcgtacgagccgacggccgcggctcgatccgggcccagtaccgctcatttcccacagctcgacactgctcatttcccacatctcgacgcccgctgcccgcaacgactctcttcgctcctgcgatgccgtgtgggatcgccacgggatgcggaagccgtggccccgcttcggccggcgcacgccctaatacgcgcgtcccgggttgaggaggtccgcggggtcgaagacggccttgatgccggtcatcaactccagctcggtgggaccgagttgtgcgtcgaggtagcgtgtcttgagtgagcccacgccgtgctcgccggtgatcgtgccgccgagagcgagcgcggcggccacgatgtcgtcgaaagcggcaccggcgcggtctgccgcgtcacggtcggcggcgtcgtagacgacggtcggatgcaggttgccgtcggcggcgtggccgaaggtgccgaccagcacatcgtgctcggcggcggttcgctcgatcgcggcaagcaatcgggggaggtcctgaaccgcgacgccgacatcgtcgagcagtgtggtgcccagcctctccaacgcggggtacaccattcgtctggcctgcatgaacatctcgccttccgccgggtcggcggtgtgcagcgcttcggtggcgccaccggcttcggccagcctggcgcaggtggcggcctcctgaccggcggacggcccgtcgcactggacgagcaggagcgccccggccgactcgtccaaccccatgcgtgtcaggcgattgacggcgcccatgcaggtgcggtccatgagctccaccaccgctgggtcggcgaccgccgcgatccgcagcacggtgtcgaccgcctgtcgaggtgtcgggaacgtggccaccaccgtcgcggtggccaccgggaacggtcgcagtcgcacggtggcgtccacgatcaccgccagggtgccttcggagccgacgaggagccgggtgaggtcgagcccggcgacgttcttgcgggtcggcggaccggtacggatcacgcggccatcggcgagtacggccgtcagcgaggcgacatggtcggcggtgaccccgtacttggcgcagcacatgccgcccgcgttggtcgccaggttgccgccgatggtggagatcgccttgcttcccgggtccggcggataccacaggccgtgctggcgggctcgggcgtcgagatcgccggtcagtacgcccggctcgaccgttgccgtgcggccaggcacgtccagggcgaggatccggtccatcgcggcgagcgagaggacgacgcagccgtcgatcgcattggccgcgccggccaacccggtgccggccccccgggtcaccactggggcgtgatggtcgccggctgtgcgcagcgtggtgatcacgtcatcggtcgagcgagcgcgcaccaccgccgccgggcgccccgcgggagccagcaggcactggtcacggcggtaggcctccatcgcgtcccggtcggtgaccacccggcccggcagcgcggcggcgagggcggtggcgacgtccgcgaccacctcggtcatggcgtctgcggctcgtagaagccgcggacgtgagccacgaccaactcggcggcgcggtcggtctcgcccgcgtccagcgcgtcgacgatcgcctggtgttcggcgagcagacgcgcgagcaccgtgccccgatcggccaccgcggcgagcgcgtcgagcaggtagccggcgatgcagtcgcgcagcacgccgatgacgaaccccagcgcctgattaccgccggcgtaggccagttgcccatggaagtccacgtcagcggcgtggaaggtctggatgtcggcgttctccaccgctgccgccatggtcaccaggcaggaccgagccgcatccggcacggccgtggtctgccgtatcgcctccgcctccagcagcgtgcgcagcgccaccaggtcggccagcgggatcgcgccgacctgcagagcggtgctcagcgccaggcccgccgcgcccgccgtgcgctcgtgggtgacgcgcggacgcgcggtggaaacggtgtccgcgccgctgatcagaccgtgcgcctgcaacacccgcagcgcctcgcggacggtggaccgcccgacaccgaaggactgggcgagttcggtttccgtgggcagctcggtgtcggcgggaaatgtgccgtcgaggatggccgcccgcaggcgctgagccacgtcgagactcaagggcacgcgcgataccggcgaaatcgtcataccgcgcacggtagctccttgtctgtttgtcagacaaggagctaccgtggttctcgctgtgcctcaggacacaaggccactacctcaaagacgcggaagtcaggtgtcgccatgaccgagaagctcgagctcgacccggccaggaccgcgatcgtgctcatcgagtaccagaacgagttcaccagcgacggcggcgtgctgcacggggcggtcgccgacgtcatgcagcacaccgggatgcttgccaacaccgtcgccgtggtcgacgccgcccggcaggccggagtaccgatcatgcacgcgccgatcacgttcgcggagggctacggcgagctgacccgacacccgtacggcatcctcaaaggcgtcgtggacgggaaggcgttcgtgaagggcacgtggggcgcggccatcgtcgacgagctggctccggtgaacggggacatcgtcatcgagggaaagcgcgggctcgacaccttcgccagcaccaacctcgatttcatcctgcgcagcaagggcgtcgacacgatcgtcctcggcggcttcctcaccaactgctgcgtggagtcgaccatgcgcaccggttacgagcgcggcttccgggtgatcaccctgaccgactgcgtcgccgccacctcgcaggaggagcacaacaacgcgatctcctacgacttcccgatgttctcggtgccgatgacctctgccgacgtcatcgccgccctgtagtcccgccgtcgccccgcccgccggcagcgctgcgcggcctcgccggcatctgtgacgcggccatcgtggaccggccgccggccgatccccatggcccctcgcccttgtgcacctcactcacggagcgcgacatgccatcggaccggatacgtgagctgatcgggcggggcgccgcggtggccgcgcgtgctccggaggagtggctgcgcgagatcgaggacgccactttgtcggcggagtacctgcaagccctggccgatgacccggatctcaccgctcagatccgccgcaccagccgcgccaacgtcctgcactgggcgacgtggaacgtgcgcagcccaggtgctccggtgccggcgaacgtcggcccggaagccttggccaccgcccgggagctggtccgccgcgggctgaacgactcggccttgcagtcctaccgcagcggtcagaacgcggcctggctgcgctggatgtcgatcgctttcgagctgacgtccgaccccgcagagctgcgggagctgctggatgtctccacccggtcgatctcggcgttcgtcgacgccaccatcgccgcggtctccgcacagatccaggcggagcgcgacgagctgacccgcggtacgaatgccgagcgccgagaggcggtgaccttgctgctcaacggggcgccgatccacccggacagggcctcggcccggctcggctaccgggtggagcagacccataccgcggccatcgtatggagtgacgccgcggagtcggacctgggcgatctggagcgcgcggccgacgccctggccaaagccgccggcgtgtcccgcttcctcagtgtgacggccggtgccgcgatgctgtgggtgtggctgccttctgccgcgctgccggcgacgaaccggctggagcgacacctggacagccatcccactgcccgggcagccctcggcagtaccgggcacggcgtggaaggctttcgccgcagtcacctcgacgcgatgaccacgcagcgcatgatggcgcgcctgcacaccgtccgctccgtggcccgtttcgaaacggtcgagatcgttgctctggtgacgcgggaaccgcagcaggccgaccagttcgtacggcgtaccctgggcggactcgccacgggtgcgccggagctgcgtgaggcggtggccgcctacatccacgaggaatgcaacgccacccgggcggcagcccgcctcttcacccaccgaaacaccctgctccgccgactcgagcgagcccagcgcctcctgccccacccgctggcggggaacacggtgcgcatcgcggtcgccctcgacgtcctgcactggcgcggcgacggatgaaccggacgtgggcccgtgcccgcctgctgggacgaaggaacgaagcatggttccgtgcggcacatcgccgggtgcacagtgcaccacccgtcccgaagacaggtgctgatgacaccttccggcgtcctgcgtgcggccgcagcatggaagggcgacgtcgaacagatcactggagggccgctcatgtccgtctctgaggcaccgacagctaccgagcacatcgatgtgctgatcgtcggtgccggcatctccggcatcggggcggcccactacctgcaaagcgagcacccgcagcgcggctacgcgattctggagacgcgtggcgcgctgggcggcacctgggacctgttccgctacccgggcatccgctcggactccgacctgcacaccttcggctacgccttcaagccctgggaagaggaggccatcgcccgcggcgacaagatcctcgcctacctgcacgaggccgccgcggaggacggcatcgacaagaaggtgcgcttccaccacacggtgcgcggcgccgcctggtcgagtaccgaggctcgctggacggtccaggtcgagcgcaccgacaccggcgagcggctgagcctgtcgtgcaaatggctgttctgcgccggcggctactaccgctacgaccaggggtacaccccgcacttcgagggcatcgagcggttcgagggcctgatcgtgcatccgcagcactggcccgaggacctcgactaccgcggcaagcgggtcgtggtgatcggcagcggcgccacggcggtcaccctcgtgccggccatggcgggcacggccgcccatgtgacgatgcttcagcgcacccccacctacatcttgcccgtccccgccacggacaagatcgcccagctcctgcgcaaggtcctgggccgacgccgcgggtatgcgtggacacggcgcaagaacatcgcccagcaagccgcgatctggcggttctgccagcgcttcccgcgcagcgcccggcggctgatccgctgggtcaacacccgtcggctgcccaagggctatccggtcgaggagcacttcgacccgccctacgatccgtgggaccagcgtatgtgcgtggtgccggacggcgacctcttcgaggcgctgagcaacagcagcgcctcgatcgtcaccgaccggatcgacaccttcaccgaacgcggcatcagcctgtcctccgggcgcaggctggaagccgacatcatcgtgaccgcgaccgggctgaacgtgcaggcactcggcggtatccagctcaccgtggacgggacgaaggtgcacctgccggacaaggtcgcgttcaagggcatgatgctgtccggggtgcccaacttctcgttctccgtcggctacaccaactcctcctggacactgaaggtcggcctgctgtgcgagcacttctgccgcctgctcgactacatggacgcccacggccacaccatctgctgcccggagctgagcgaccccgacatgcccacccgcccgctgctcgacttcgaagccggctacatcaagcggggcatcgaccacctgccgcgccaaggcaccgaggaaccgtggctgatgtcgatgaactaccaggccgacgtcaaactcctgcgggaagactccgtggaggacgagaacctctgcttctcctcccccaccgccaccccccgcccggcgcgcggcctccaggcgacggcacacctggaaccatgaacgggtcgacgtcccaggcttggagatgctgtcggccgacccggccaccgctgccgcacgccttgcggagtgccggccgtcggcgattccgctgaccgcgaggacggcacggcgaccgcgcccggggcgtcggtgacggcgcgtacccgaagcgctcggccaggcgtcgcacgcgccatcaaccctgccggacggccgaccggacggctggaccaccgcccgggctgtgaacgaggcgtgggttacataccggccacgggatgaggacaaagccgcgcggcccacgtattgcctccgagagaagaagaaggaaaaccccagggcgcccggcgcagaggccctcgtcaccatccggcctctggtacctgaccgccgctgacgaaagaaatggcccgtcaggaacaagacaagttgaggaggacccggtggctcgcaacgacgccaaccctgagcggactcccgcctcaggccctgacaacgcgctggagatcagggactccttccaagccgtgctggacgctttggatgccgcacgcgccgacctcctgcgcgacgagcggcaggaacacgccgagggcccgtcccagccccagatccggcccggtcaaccgaccggggatgcccgccttccccagccgacctcgcccccggcttcctccacatccggccgggcgctgccggtcagacgtgcgtcgtccggcacgcaaccggagcgtcccgggccccaccggccaactgccgctgaatcgccgccgaccggcggcctgcgccaggccgacgccccggaggccgtcatggccgagccaccgggattacccagcgagctggaggccgtcccgcccccgccggcgggaaagccaccgacggccagtggaccggggcctggaccgggtccgggacctggacctggacctggaccggggcctggaccggaggctgtcgcaccaaccgtgcctttccccactccggctgctccctggcaggaaagcgggcggagcaggagccccgggccgggcaccgctgggccggacgtaccactctgtccggccgccccgttcgaccagttcgccaccgcgccttcaaagggatctgcgccatccgtccgcgcccacgggagaaagaccagcggcggacggcggcgatccaccaaccgcagggacctgcgagtggccggcatctccgggctgggcgcggcgagcggactgatcctcgcctcttggctgctgacctaccacaacgccgagcccgcgacctcctcttcgcctcccgggcacgtggaaaccccactgccggcgagtcccgcgccgaaggacccctctcccccggctccggggcagacgaaccgcccgcagcccagcaccccggacccgccgctccccgaaatcccgggcacgggcctcctgcgccaaggcgacagcggccatggggtctacgaattgcaggtacgtctcctgcagatatcgcacgtctacgacggcggcgcgatcgacggacgttacgacgcggaggtccgagcggccgtgaccctgtttcagaagcggtacgggatccgaggcgatgagagcggggtgtacggcgacaacacacgtcatgccctcatgctgcggaccaaatgaccagcggcagaaggccgggggacgcgcgggcgcggtcagggtgatgggccacgcccgcgtcgaagaccgtctgcggcgggccgacgtgtgcctgccggccggtacccggctgccgctgccggcacgcggcggcctcgaccgggcctggccaccaccgatgttcgtctgcctccccctgccgggcggtgcccgccatgaacggcggtcaggcgggccttcgggatgcgctgtgcgcggtgaccggccggctcccgccgcgccatgatccggattcacagcccgagcagcggctgttcggtccagacggtcttgccctcgcgggagtagcgggtgccccagcgctcggtcatctgggccaccaggaacaggccgcgaccgccctcatcggtcgtgcgggcgcgccgcagatggggtgaggtgtggctggcgtcggcgacctcgcagacgagacatcgttcacggatgagccgcagggtcaccgggccgccggcgtatcggtaggcgttggtgaccagttcactggcgatcaattcggtggtgaacgccaggtgttccagtccccattgactgagctgggccgtggcgagcgctctggcctgggcggcggcggtcggctccagcggcagttgccaggacgcgacgttctccggtggcagtacccgggtgcgtgcgatgagcagggcgatgtcgtcagcgggctgtgcgggcacgagggagtcgacaaccgcctggcatgtcttctccaaggggtccgccgggtgcgtgagcgctgtgcgcagccgttgcaagcccgtgtcgacgtcgatgtggcgttcgccgatgagtccgttggtgtagagcgtaagcaggctgccctcggccagctcgatctcccgggcctcgaacggcaggccgcccaggcccagcggtgggcctggaggcaggtcgagcaaaccggcctgcccgtccggtgtggtcacgaccggtagggggtggccggcgcgcgccgcggagcattgccgggaaacggggtcatagacggcgtacaggcaggtggcgccgacgatctgctcgcccgcgggtccttcgccggctgtctcttgttccgcggccaggaggttgaccaggtcgtccagtcgggagaggacctcgtccggttccaggtcgagggtggcgagggtgtgcacggccgtacgcagccggcccatcgtggcagcggcgtgcagtccgtggcccaccacgtcgccgacgacgagtgcgaccctggccccggacaacgggatgacgtcgaaccagtcaccgccggggccggacgccgtactggccgggaggtagcgaggggccacttcgacggccggctggtgcggaaccgtcctcggcagcagggtgcgttgcagggtggacgcggtctgctgctgttgggtgaagcgtcgggcgttgtcgatgctgaccgcggcgcgcgaggcgagttcctgggccagggtgagatcgtcgggctcgaacggctcggggtgccgcgatcgccacaggctcatcacgcccagtaccaggccgcgcgcggccagtggcaccacgatcagggaatgggctgacaggtccggtgcgtgctcgccctgacgcggttctgccaagaaccagtcgggcgaaaggaccggttccaggaccggacgcccgtcggccagacagccggcctgcggtgtgccgggtgcgaactgcaccggctccccttccgggtactcgaggtcgggctgccgggccacgacgccgcggaccgccacccgtgcgacgggccccgtcggcgcctgcgccggctcctcgccgcgcatcaccggtggcgacaggtccaccgatacgtggtcggccaggtgggggaccatcacatccgcgagttcgcgggccgtctcccgcacgtcgagcgtcgatccgatgcgggcgccggcctggttgaggagcgccaggcgaaggcgggcccgatggcgttcggtgacgtcctcgaccgtctcggccacccccaggacccggccggcgggatcctccagccggaaggccgagacggacgcggcccgcacgcgtgccggatcccgctccaggcgggcgtactgctcggtggagacctgtgatcttccggtctccaccacctggcggacccggtccacggatgtccgcgcgtcctcggcgaccagcagggcgcccgtgggcattccccgaaaggaggcggccggaattccggtgaaccgttcgatcgccctgttgacccgcagaatcgtcagctcggggctgtgcacgaccagaccgatcgggcaccggcggaacaatccgtcgaggaccgcgcggtccctttgccactcgaggacctccgccgcgggtgccccgacgaggaaccattcgcggacatggtcaccgcgcagcagcgcacgtgcccggaaacccatctccacgagccgcccgctgctgtgccgcaccgccagtacgccgaaccagcctccgtccctcctgcacgtcgccgcggcgtccttggcggccggcaggctgccgggatcgatcaggacatcgaaggccggacggccgatcaccgcggactccgggtagccgagcaactcctgggcccgccggctccagccgaccacggtcccccggtcgtcgagcaccaccgaggcggcgtggtgcagagcgaacggatcgtccccactctcgctgagcaccgtcatccgcttttccaccccggacaccacctcgtatcggatacctatgtcgtccactccggttcttcgcacgcggcccgcgaccgtcgtgacgcggacccgggtgggtcgctccctgctcccacgcctggtgggggaccaggctgatgccatgtgacgtgttgaacgcggtcaaggccggcagcccgccgggcgcggtgtcacggcgtggcggccaccacccgcacgtcccacgatggatcccgcccgccatccacgccacaggggccgggccaccgtcctggtccgtgctgcgtcgccgcccgggcggcgacgccgggcagacgccgcgcgccacggccgacgtgccggatcggcccgtcacgtcaggctcgacgggacgatcccgtagcggcgcatcttgcggtacatcgtggcgcgggagatcccgaggtcctgcgcggtccgctggacgttggagttgcggtccagcaacccgcgcagaatggcgtcgcgttccagcgcctcgatggtggtcaggaccttgtgcgaggacacccggcattccggcggcaggtcctccacgtggatcatccggccggaaggccgtcgcgccaggccgcggatcaccgtctcgagctgccggacgttctccggccaggggcatcgctgaagcagggccagcgcatccggggagaacgtgttctcgccgctcggccggtacttgcgcaggaacaaccgcgccaggtgctcgatgtccccataccgatgacgcaggggaggcacctccaccgaggcgccacagagctggtcgaggtggtcgtcggcaccgaccatcgacggctggcagatcatgaccagctgcccactcgcgctgccgtccagccgcaccagcaggtccgccagccgctgccgcagctggtcgcccaacaggtggacgtcgctcaggacgagcacggtggacggcacgacaagcagctctccgatgtcgtgcagccagcgctcggtgacggccggtgaatccgacggcggcgcttgtgtcatctccagccggcgtccggcgccgtgggcccggtgcagggccgcgaccagcgtcctcttgccgacgccggcttcgcccaggagatgaagccaggtcccggcgacgaacgctgcttcgctgtcggcgaccgcgcgcagccagtgcggggacgagcccaccagtcccaggctggagcgggcgggcgaggcggaacccgcagatgtgggctggagccgtccgatcagccggactcggaagacggcgcccgcgtcactgtcctcgcgccgacagcgactgaccctgagttcggcgacccgtcccgagggcagggcgatgctgcgggtcccctcgagccggggatggtcggcgatctcacgggcgtgatcgagcagcgcatagtgatccggcccggtcacggcggcactgagcggctcgttcatcatgacgacatcgcggttgagggccagcacgggtcccgggcgcgtcgaggagcacgcctccatgtagtcctggaacagagcccgctcgcgccgcgaggtgatcgccgcgatctcggcctcgatctgggccgcgaccgagcgggcgaaggccatcagcatgccgccggagccctggcggatggtggtgaggttgaaggctcccagcagggtgcgccgggtgggatgcaggatcggtacggccgcgcagtggaagtcccgcagcgcctcgacgtagtgctccattccggcgatcatcaccgggcggccgctggccagcgcggtcccgatgccgttggtgcccacgtagcgctcggcgaacacatggccgggggccaggtgcacgcggttgaggttcgtcgtcaggccctcgtgcgagaccttccgggacaggaccacaccgttacggtccgtgatcatcgtggagaccgggtcgtcggcgagctgctcgtgcagcctgtcctggatcggcagcgcggcccttgcgagggggctgtccagattggggttgtccaggtacggagcctcgaggctgcccgacttcacctggtattccatcgagcgatgccatgaggccaccacgagcggccgggcgcttggatccttggtgacttccaggtagagctctctggctgctctcagtgagcttccgggttgttggcggggcattaacactcccgtactgcgcgcgtcacaatccctcggttcagtgattggaccagctcgatggcgtggcgcctacggcgtgtatcacattgagacattcgcggacggattctgagacatcgccctgcgatcggcggcctgtgtaatcggcgcaccacccacccgccgactcgcagggagccgctatgaaagccgtgcaggtcatcgagtacgacgagccgcccgcgctcgtggacgtaccggacccgcagatcaccggcccgctggatgtgatcgtgaagatcgggggcgccggagtctgccggaccgatctgcacatcctcgaaggacagtggaaggacaagagcggggtcgcccttccgtacacgatcggtcatgagaacgccggctgggtcgccgaggtcgggcaggccgtgacccacgtcaaggtcggtgacccggtcatcctgcacccgctggtgacctgcggtctgtgccgcgcctgccgggccggcgacgacgtgcactgcatgaactcggcattccccggcatcgacaccgccgggggctacgccgagtacctgaagaccaacgcccgctccatcgtgcccctcgccccgtccctggagccggcctcggtggcggccctggccgacgccgggctcacggcgtaccacgccgtcgccaaggcggcgcgggtgctgcggcccggtgacaaggccgtggtcatcggcgccggcggactcgggcacatcgggattcaggtgctgcgggccctgtcgccggtcgagatgatcgtcatcgaccgcagcccggaggccctcgcgctggccaaggaactgggcgccgaccacacgctcgtcgcggacggaagcgaggccgaacgcgtacgggacctcaccgcggggcacggggcggaggccgtcctggacttcgtcggcgaagggggcgccgtcgagacgggagtggcctgcctgcgccgcaacggcaattaccacgtcatcggttacggcggccgtctgaacgtgccgacgatcgacgtcatctccacggagatcaacttcatcggcaacctcgtcgggtcctacaacgacctctccgagctgatggtcctggcggcccagggcaaggtcaccctgcacacccagcgctaccccctcgcctccttccggcaggccctcgacgacctggacaccggggccgtacgcggccgagcgatcttgatcccctgacacgtccaaggagcacttccatgcgtacgagaccctacaagcggttcgccgccgtcgcggccgtcgcggcgctgaccgccaccgcgtgcaccgccccggaccaggcacaggaagggccgaaggacaaggccccgctcttcaagctcggctcgcagatcagctacgagaagtacggcaaggactacccggacaccaaggtggaggacgtcccggggccgtgcagctatgaggcgatcagccggaaggactactccgggcagacgctgaagatcatcagccatgccgtgccggtaatcggcgagccgactcagctgcacgccaagcagttcgaggagatcaccggggcgaaggtcgaggtggtcaacgtccccttcggtgagctgcaccagaagatcctcacgccccttcaggcgggccagcccgcctacgacgtgatgttctacccctcgctgtggataggcgacctggccccgtacctcgcgccggtgccgaagaagtatctgaacactcccggcatgaaggacgtcacgggtacctatatggacgtggcgacttggaacaggaaggtcgtgcagtaccccatggacggggaccggcactacctcaaggtccgcaccgacgtgctgaacgaccccaagcagcaggcggcctacaaggcggccacgggcaaagagctgagagttccgaagacctgggacgaataccaggacgtcgccaagttcttcagcggcaaggacttcgacggcgacggcaagcgcaactacggcagcgccgaggtgaccaagcgcgacgatctgacgttctccgccttcatcagccgggcggcgccgtatgtgaagaacccggacgtcaagggcggtgtcttcttcgacctcgagaccatgaagccgctgatcaacacgcccggcttcgtccgcgccctggacgacatggtgaaggccaagtcgacctgggcacccggtggcgccaacttcggcctgggagacgagatcttctccttcggcggcggccagacgctgatgtcgtactcgtgggacgacgccttcatccaggcccagcagcccgacagcaggatccgtaacaaggtgcaggcggcgccactgcccgggtccagcgaggtctacaaccgcaccaccaagtcgtgggacacgaaggcgaaccaggctccctacttcacctggggctggacttcggcggtggccaaggcctcacgccaccagcagatggcgttcgactacctgtgcttcttcagcaacgaggccaacaccgccctcgacctgaccatcggccggttcggcgtcaacccctaccgctactcccacttcgacccgagcttctgggagaggctgggctgggacccgaaggtcgccaagtcgtacgtgaagacgctctccggtatggaggagagccgcaaccgcgtcttcgacctgcgcgttcccggtgtcaaccagtacatgtccgcgctggccaacggcgtcgccgcggcgctggcgggccaggactccccgcaggacgcgctggacggcgtggccggggaatggtccaagatcaccggtcagatcggcaaggacaaggtccagagcgcctatcgcaacgtggtcgcgctcgaggacaactcctgatccgaccgcaggacgccccgggtggccggaccggaccggccggccacccgggggcgcccgcccccttccgcaaggagaaccatggacggcctgcgccggcacaagagcatgttcctgctgccgggactgctcacactctttctgatcatcattttcccgcttctgttcaccatccgggtcagcttctccggctggaacgtcagcaaccctcagatggacttcatcggaggcgccaactacaccgcgatgctgcacgacagccgtttctgggcctccatcacccggctgatcctgctggcgggcggcacggtcctgatccagtacgtcatcggattcggtatggccctgctggtctggcgcgaggcgcgcggccgcagattctggcgggtgctctttctcgtccccatgatgaccacgcccgtggtgatggccgccatctggcagacgatcttccatgagtcactggggccggcgaacgatctgctggggatgctgggcctgacgaacattccctggctcaccgagtcgggtccggcgctggtcgcgctgatgaccgtcgaggtctggcagtggacccccttcatgttcctgttgctgctggccggtctgctcagccttcccaaggaaccgttcatggccgccgcgatcgacggcgccggcacctggcgcaccttctggaaggtgaccttcccgctgatggcaccggtctcggtcgcggcgatcgtcatccggctgatcgaggcgtccaagctctccgacagcgtctacgtactgacgtccggcgggccgggatcctccacggagaccccgggttactacctctacatccaggggctccgcgatcagcagaccggctacggcggggcgatgtccctgacctacctcgtcctgatgatcgtcacgctcacggtcgtcgccgccctgctcaccagggccttcaagctgaagggggactcatgaggtcgcgcctttatcccgtgttcaagtacaccgtgatcgcgctgtgggcctgcttcgtcgcgggaccgttcctctgggccatgacgaccagcttcaagaacgccaacgccgtccagggcggtcccacctacatcccctgggtgcagtacaagcccaccctgaccggctggcacaacatcttcggcggggccggcggtatcgatgtggtccagcccttcgtcaacagcgccgtcatcaccatcgccgcgtccgccatcagcctggccctggggtccctggccgcctacgcgctgtcccggtaccggttcaagctgggtttcatcaagaacagcgacatcgtcttcttcttcgtctcccaacggatcatgccgcccgtcgtcctggtgatccccttcttctacctccttcagtggggcggcctcctggacagcatcccgggcctggtcatcgtgacggtcgcgctgctgctgccgatcgcggtgtgggtgatggtggacttcttcaacggcatcccccgggagatcgacgagatggcgatgctggacggctgccccccgttccagaccttcgtgcgggcgatcctgccgaactccctgcccgggctgaccgtggcggcgatgttctgcgccgtgttcggctggaacgacttcttcttcgccttccggctgaccttcaccgaggtccagacgctgccccaggcggtcgtcgccctcaactcctccattccaccgtggtggacgctgtccgccgccgcgctcttcggcgtggcaccgctgatcctgctcgccctctgggtggagcgtctgctgtccaagggcaacctgtcgggagccgtccgatgaacctgcatgccactgatctgtgcctgaccgtcgacggcgtcgaccacctcaagaacgtgaccgccaccttccggccgggccggctccacaccgtcatcggccggacgatggccgggaagacgacgctgctgcgggccctggccggcctgcagaaagtggactccggctcgctgacccgggcgggagccgacttcctcaagacgccggtgtggcggcgcgacaccgccatggtctaccagcagttcatcaactacccgcatctcaacgtgttcgacaacgtggccttcccgctgaagcgggccgggctgtcacgggacgtgatccggcgacgggcccggcagagcctggcgagcgtgggactcgcggacttcgagaagcgcaagccctcccagctctccggcggccagcagcagcgcgtcgcgatggctcgcgccctggcccgcgataccggcatcctcctgctcgacgagccactggcgaacctggactacaagttgcgcgaacaactccgcgacgagttcaaggccctcttctcggaccagggcgacacgatcgtcatctacacgaccaccgaacccgccgaggcgatgatgctcggggacgtggtcctggtcatgcacgaggggcggatcctccagaccggcaccccgcaggaggtcttcgaacgcccggcgaccaccacggtggcgtccatcatcaacgacccgcccatgaacatcttcgcgggccggatcgagggcggtcaggtcacggtggccggcttccaggccacgcacatctccgcgcacctggccgacctgcccgacggtacgtaccagttcggactgcgcgccaccgacgtcggcctggcttccagcggggtcgagggcgaggtcaccttcgtcgagatctccggctccgagaccttcgtccatgtggtcgtcggcgagacccccttcgtcgtacagatcgagggcatccacgacgtcgccctcggcgacctggtcagacttcggctccgtcccgaccggctgttcgccttcgacgagcaggggacgctcgtgcgaacaccttcatacgatctcgcttcagtggaagggcgctgacatggcgcagttggacatcgtcgacgtcgggcacgcgtacgcgccgggtgccgaggaggagcagtgggctctcaaaccgctgaggctgaccttcgagtccggcaagacctatgcgctggtcggaccctcgggctgcggcaagacgacgctgctgaacatcctgtccggcctggtcagaccatcccggggacaggtgctgttcgacggcgtcgacgtcaccgccctgcccacgaaggcgcgcaacatcgcccaggtcttccagttccccgtcatctacaagtcgatgacggtctacgagaacctcgccttcccgctggaatgccggcgctgggacaaggcgaggatcgacgccaaggtccggcaggtcgccgaggccctggacctgcacgaccggctgaggcagcccgctcgcgggctcaccgccgacgacaaacagctgatctcactcggccgcggcctggtccgtgacgacgtggcggccgtcctgatggacgagccgctcaccgtgatcgacccgcagctgaagcactcgctgcggcgcaagatccgagagatcaccgagcagttccggcccacggtgatctacgtgacgcacgaccagtacgaggcgatgagcttcgcgcaggaagtgctcgtcatgaaggacggccgcgccgtacagcaaggcacccccgagcagctcttcgaggcgccctcctccacctacgtcggctacttcatcggctcaccggcgatgaacttcctgaccgtggaccggaacgagaggcccttcgcactgggcggccggacgctgtccgttgcctgggacatcccccagggcacgaccgacgtccaggtcggcgtccggcccgaacacgtcaaggtcgtcaccgaccccggccccaacaccttccccggccggctgcggagcgtcagcgaccacggcgcgcagcgcgtgctcgaggtcgaggtcgccgggcaactcgtcagggccaagactccgcgggaggagggagttcccctcggcgaggcggtcctcgtacacctgccgcgcgccaaggtccttccgtacgcggacggtcagttggtactccggtcgtaacgatccgccccacctacccgccccacctacccgccccacctacccgtcccacctacccgtcccaccgcggcgggcccccaccaggggcccgccgcggcgcgtgacgcgccgcggccgtgcggcggaacgccgacgcgtggggtgcacgcgacgcttggctgatgcacctggatgtgctgcgccgaccatgtccagagcgctggacgcgaagtctggacctgggttgttccgcttcgtgcggtaatcaccgaactccgggcaggggcacgtccacaccggtacggtgcctaccagatggggagtgacgcacctaactcgtatgcagtggggtgaagggtgccattgcgctactgggggacacatgtcggagatatcgacagcaatcgacgccctgctgcaagcccggctgcggcagttacccgaggtggaacgcgaaagtgcgcgctggcacacgctgggcgagcgcctcgccgagttggcggacgcactcgccgatctgcgggcgcacaccaccatggacgccgaactggtggcggccctgacccttcctcagctgacggagacccagctgtccgtagcgcaagcagcggactcattcagagtgatcgcctcccgcttcacccgggcaacggtcaacatcggtgtgagcggcgcggcgcgcatgggcaagagcaccctgctgcagtcgatctcaggcctcgacgacaaccagattccgaccggtcacggcatcccggtcaccgcggtccgcagccggatcttccactcacctgcggtgcggcgggccgagttggagatgcacagcccggagagcttcctcgcgacggtgatctccccgctgcacgcggcgctcgatctctcccccgtgccgcgtacggtcgccgaattcggccgctgggtctatccggaagtcctgccggacacccgggacagggtgctgctgacccggctgcgtgaactgcagagtgccctgacgtcgtacgagccgctactgaccggcggtgtcagaacggtgccgctggaggaggtgcggccgttcgtggcgtacccgacccatgaggagatcaccaaggcgggcgagcgggtgggacgtgcctatgcggcggtgcgcgaggcccgcatcgagtgcgccttcccgcatgagcatgtggccaggatcggcatcgtggacctgccgggcctcggggaggtggtcgcggacgccgaccggcggcatgtcgcgggtctgcgcaacgaggtcgacgcggtgctggtggtcaagcgttcctccgacacctcctcgtacttcgacgagacggacaccgccggactcggccttctcgaggaggtacggggattcgtgcgcagcaccggggaattcacctacttggtgcacaacgccgatccggacaagccccacctcgcggagaacctccgcggcgatctgctgcgcaatgtcaacgggggcgaaccggaccgcttcttcaccgtcttcgagaccgacgtacgcgacccggagcgggtcggccgggaggtgctcggtcccctgttgaaacggatggcggaggggctgcccgtcatggacgccgaggtgctcgccggcatccgcacccaggcctcatccgtacgggaccgtgtccgcctgcagctcaccgatctgcgtctggcgctggaccaggtggcacagcgggctggagttccggaggaagtcaacgacgccaaggccgcgcagttgcgcagcgctgtcgccaggcggttgcgcgggctggtcgccgaactggccgcggaggcgcacggctcgatggtaggtccgggcttcggcgaagcgcttgagaaggcatacgagggcgtactcgagtggatccaggacggcttcggcaagggcacggacgcctggcgggaggaggcgctgacctgcatgatcaccgaaggccactcggcggcgttcgcggggccggaattcagcagggtccgggtcgagatcagccgccgcttcgcggccctggacgacttcttcacggcacgcctcaacgccgcctggaaccgtactgccgcgatgctcgccgccgagtgcggagcgcttttccagcgtaatgacagcaggcaggcggacagtgtctccagctccgacgacgccactgccacaccctccgcccaccccggacgcgatgtcctcgccgagctggccgaactgttcgcccgttcctcccagccgtgcccgggtcttgcctccgcggtcgacagtctgctggacgtacggctggagtaccgcaccctgctctacccccgggtacgccccgagctcgccccgctgaacctccaggtcactcacccgaacacgggcgagcagatgcagcaggtggcggttcccctgaccgcagagggggccgagcatctccacgagctgttcaacagccttgccgagcaggcggcgttccggatcaagcagtcgctgtcccaggaagccgcggtgcctgcggctgtcatccacgcgctggtggagcagttcgaggacaccctgatccggtccggcacgtcggtcatggaattccggcggttcgtccgttcgtaccgcaacgacctgtggccggcggagttcaaggggatcgacgaggccaacagccgcttcgcccgcgtcctccgcgttgtacaggacatctccgacgtactcgatgaggagcagccgtgacggacgaacactcggtcttcgagtacaagatcggcttgctggcccccagccgcgtgggcaagagcacgctgatcgccggcctgctcaccgagggccaacagcagctggcacaggactcctcggtacacctgctcaccgcggaccggcccaccaagaaccggctggccgccacctacaacctggtctccggagcgctcaaggcccggatgttcgagccgggcctcgtgcccagtaccagcgatccttcctggttccggctgctgctggaagcacgggggcaagacctgcagatccggttcgacatcctcgactacccgggtgcgtggctggaaggagccggcgaaggcaccgaggacgagcagaaatggaacgaatgcgaggcgttcctcgccgacagctccgtgctcatcctcccgatcgattcggtgctgctcatggactccggtgacgaccacgcgcatctgctcgcctctcacctctccgtattccagatcaaccaggccgtactcagatgggcgaagaaccggcgggagctgtccggtgagcccgcgatgatcgtgttctgcccggtcaagtgcgagacgtacctgtcggacagcggcagtctccaggatcacgcgggtacgttgcggggcaaggtggtcgaccagttcagcgatgtactcaagacggtccgggacgcggccccgcacgcggcggtccgctacctcccgatcgataccttcggctgtgtagagctcgtctcggcccgctggatccatgcccagggatctcccggcggcgagatgctcgtgcccaagtaccgggtccggccacccggccagatcgtccggaagggactggacgacctcctcaccctgctctgccggcaactggtcgacaccgcgcgggcgcagagcgagcggacgacagccgcgaagcagacggcggccctgaattcccgaaaccacgcggagttgagggagggcttcttccgcgacctgtggctgaacttcaacggcgaacgcaaccgtcgcaggcacacagccgccaccgacgagaggctgttcgccatgtcgcagcggaccactcagtcgctcttcgacgtgctcaccgccctggccgggcgggagagcgggccccgtctgcaccacctgagctgaccgccgaagggactaccgtgcacgtttatcttcgtacccggggtgtgccgcgcaaactggactacggcttcctcggcgccgcaccaggaagccgctggtgggacacatactcggagctcaccgccaccgagcgtccctgcttgctcgccgtcacgtcgaagggccgctggcgggtactgatcagcggggtgccctccacccgaaccgactccgtgggcacccttgtctactacaccctggtcctcgacggctctccttctccggccggaacggtggggccccggcaggaccggcccacggtgttggcgctcgcgtcacgttggctggacgacatcgcccgtcacccggagggccgcggggtgctgtccgagctcctggacggtctgtgttccagcgcggaggtggatcggctgctggccgcccgccactcggagctcaccaccgagcgcgcggagctcaccgcccggctcgccaccgcgctggcatccctgagccccgccccatccctgaaccccgccccgtccgtcccgtccgcgcaggacagcggcgccccttctcccgtcctgctcacggagcgctggatcgccggacggacagcaccgggcgccgacgcggccttcctggcccgactgtcctcgctgctgtccggggaggacgggcaggcgcacctgctcaacctggtctcgtccgccgaagacatcaccacactgcctcagaagccagggctgctggccgtactcattgagggcggcatggtcggcgaccccgcgatgccggccgaggcgcttccgaagctgccttcggaggtcgtcgccagtgccccaaaagcacggtggcgggcggcaatggttcccacagtgctgaccgccttgatcctgctgttggtggccctggtgctggtcgccggcaactggacctgaccaagccgtttctgagccagggcaagatccgcttccgcagcccggaaaagcgccaggtgcaggtctcggtcgaactccgggcaccgagacggcgtctgacgttcttttccgcggccacctatcaaaaagagtggctggagcccgattccctgctggccttccgctgtgaattcgtcgcggacgaagcgcggaccgggcaccccgtgcgggccctccttctcgcgcggctggccgtcggccgagcccgagtattcaattacgaaacggcccgctacgaattcggccgggtagaggacctcgacttcgccgtatctttggatggtgagacggtgtacgaggcatacggtgcccggccgatggaggaggacagggggctgactttcaaggacgagaccggttactggaccacgatccgcccgataacgtccgccctgaagcaggcagtgcgcgatgagaatccgtgacagcatgtcagcccgccgaacagggctcatcgtccagagccgcgcgggcggaaccggtgaagtctttcaaccgcgccctggcttcgagcacgtgtgcagcgtgcctgtctctccatgtgtcggtcccagctcctcgcaggctgtcggcgtgccaggagaagagatcggacaaggcaatgccgagagccgtcgtcagagcgtccgcggactcgacaaccgccgtggacccctccaccgccacagtggacgcggcgcggcgagccgcgctcaccagattctcggccgccctgatgcgctccatcgcctcttcgaggtgcacgggacctgcgccactcagcgctgtccaagccccccgcaagccttcctcggccgccaccgcctcggtgatcagtgcgctgtacgcggcctggcgaacttctcggcgccatcggtggtgctccaagtaagcctgtgatcgcacctgccagcgagtcgaccacgctgccacaaccgccgcgaccgttgtccccgcgacgccgaccgccgagcccaggattgccgccacccctgcgtccacccgcccaattctgaggccgccgggccgagcgcaccagagacgacttcccgatggaggtcgtccgggaagccgagcgacaggcacctcttcttttacgagggcgggatctctgccgcccatgtggctgccgtgtcgaggtccagccatgcttccccggtcagatcggtggtggcccagcgggcagcggagacgacctcctcagaggtacggaaacctgcgaccacgcaggccacgctggggtcgcgcagcggaaaccgcagggcggcgtggggaagtgcggtgccgtgtcgaccggacaccccggcaaggagccgagcacgacgcagtgccgattccgaggcggggccgtagtcgaaggtggcgtcattcgcggggtgaggacggctgagcagaccggagttgaacggggcggcggccaccaccgcgaccccacgttcggcgcacgcgtccagcaaggggcgagcggtgcggtcgagaagggtccaccgcccggccaccatcactgcgtcggcctccgcctccgcgacgacgcgcagcagcggggcgaccgcgttcatgccgacaccgacggcaccgatgacaccttggtcgcgcagagccgtcaacgcgggcagggcatggtcgagggcggcgtccagatgatcgtcgggatcatggacgtagacgatgtccacatggtccaggcgcaggcgattcaggctgccttccagacttcgcagtacaccgtcccgtgagtagtcggggcggcggaccagcgtgtcgggtacggcgaagcctcctgccgtcaggtcggatccggtgggtgccgggtggggttccagcagtcggccgaccttggtggagatggtgaactccgaccgtggacggtgggcgagggcatcgccgagccgccgttcggacagtccgaggccgtagtgcggggcggtgtcgtagtagcgcactcccacgtcccaggcggccttgagggtggcctgtgcctggcagtcgtcgatcgggccgtagagattgccgaggggggcggcgccgaaccccagcgtgctgacacggacgctcgtacgaccgagcgggcgggccttcacgaggggattccgtaccagcgcgcggccgttgtcccgaagaccgcttcccgttcgtcggcgctgagctcctcggtgagcgattcggcgacggccaccacttcgtcgtactcggcggcgagcaggcagaccggccagtccgaaccgtacatgaggcggtccggtcccatcgtctcgaacaatacgtccgcgtaggggcgcagagccgcggccgggtccccgccggtccgggtgaccaggccggacagcttcaccgtcacattcgggcactcggccagatccgtcagcagcgcggtccaggagacgaggccgtccggactcacgacgggattgccggcgtgatccagcacgaaccggacgtcgggcaactcgcgcacggcccgcaccgcggagggcagttggtcggggcggacgagaaggtcgtagacgagacccgctgccgcgaccgacgtgatgccgcggcggacctcggggcgcgccggccactgcgggtcggtctcgtcctggatgccgtgccggataccgacgagcgcggatccgccgggttgctcccgcagttccgcgaggcggtcggcgatgccgggttcggtcaggtcggtccagcccacgaccgcccgcacctgcgggtccgtgcacgtcagggccagcagttccggtgtctcctgcggcacggcgatggtctgtacgacgacggtggcgtcgatcgcgttccgttcgagagccggcctgagttcagcggcggtgaaggtccggcgcagcgcgggcacgtcgctggtccacggctgatcgcgaactgacagatcccacaggtggtgatgagcatcgatacgcacgcttcggtccttgagcgtcgagaaggactggcgagggaaaggcgcacgcgcccactgcgaggagcgcggcgcgggagcgccctcctcgcggcggccggtgcgtgaggtgcggcccgcggacggctcgggcgtacgtgaggtctcagtcaaggccggcggccgccgccgattcccacttccacgatgtctccttcgtgcgggtagcgttcatcggtcagccaagtagcggatcagtccggcaccccgaacatcggaggtgcgcttgtcccactggccacggtgttccaggcggtccccgggggccgggggcgacttcgggcgaggctcgtgccgtcggcgggtcctggtggccgccgcgtgcaggggccgcccggcatcgcgtaccgcatgaggaaggatctgcttcatctggcaggcaggaccttatggatgggatccattctgcgcaacatcctgacgggagtgcgtagttcagtccgttttgatgaggtcttcgcagggcttccgcctgaggtctgtccgttctcttcccaactcgcagcggcagtgccatattggccaccgtcaatgaatcagattaatccgtgacgcaagagggaggttcgccttgggcgactcaacacaggctcctggcaaggcagatgacgcgacgtcacgtccctaccgtccggggtatgaactggtcgcggagcaactgctggactacatcgcccaggagaacctgcggcccggcgaccgcctccccaccgaacagggcctggcccagatcctgggagcgtcccgcaacgtcacccgggaggccgtgaaggtcctggccgccatcggccggctcaatgtgcggcggggcgccggtatcttcgtcgccgcctcggtcggcgggctgctggacgacgaactctcgcacttccggccgaccagcatggaagacgtccgcatgctcctggactaccgcaaggtgatcgagtcggagacagcacgccgtgccgcctccctcgccaccccgatcgaggtccgggccatacgggagagcgcggagagctccctggcagcggccacgatgaacgacgtggacaccttcgccaaggctgatgcggccttccacgacgcggtgggcgccgcctcgcacaacgtgttcctgaggtcgagtgtcgccggtgtgaggcgcttggcatcccagtccgacgtgctgctcttccacggtgacgtgcccggatcgctggaagtcgccgcgggtcagcatgtggccatagcggaggcggtcgccgcgggggcggccgatctcgccgagcggctgatggtggaacacatcggcaccacacagagccagttcgagaagaagattcgcgaccggctgttcagtcccgacgccgacacggccccttaggcgcccccggagccttcgaggagcggcggctccggggctccaccgccgtccgcggaggcggcggcctcgtgaaccggccgaccccgcatgtgccgcagcacagcggtcgagccgcccatcgccctgggagtcccggtggacgaccgggactcccaggtatcacccccctcaggcgattggatacgtgtgtctcatccgtctgcgcgcaggcgcgtcttcgcgccgctgcgaagaagtttcacggccgccttctcggtggccgcagtggcagccctgctgactgccgtgccggcccaggcggctcccccaccgccggacatcgatgtctatgtctctccagccggccgggacgtgggctcaggtagcgccgcacaccctttcaggacgctcgagcacgcgcgggaccacgtgcgcgacgtcaggcggaacgccaaaggcgacatccatgtccggctcatgtccggtacctaccggctcagccgtacgttcgccctgaccgcccgggactccggccgcgacggacacaagatcgtctacgaggccgcccccggcgcacatccggtgatcagcggaggcgagcgaataaccggctgggttccggccggcggagcaggacgggtctacaaggccaaggtgggcgacatcgacacccgccagctgtatgtggacggcgagctggagacccgggcgcgcagcgccaagaacccctccggcttcagcaagacgtccaccggctacaccttcaccgacaccggcctcaacgcctacaagcgtccctcggacctggaggtcgtcagctcctggggctggaagctgatgcgctgccccgcgcagtcgatcgccgacaacaagatgacgatgcagcagccgtgttggcacaacgcgcatctccagcggggccaggagatccagaacccgacctggctggagaacgcccgcgaactgctggacacgcccggtgagtggtacctggacaagggcgagggcgagatctactacatgcccaaggccggccaggacctgtccaccgcgaccgtcaccgtgccgcgcgtgcaggacctggtggacctcgacggcaccaggaccgacccggtcagcaacgtgtccttccgaggcgtcaccttctcctactccacctggctcgcgcccagttcctttgagggcctcatcgagggccaggccggcttccggatggtcggccacgaccccgacttcgacgcgacccgcctgaagtggcagaagacgcccggcgccgtcaatgtcagctacggccacggcatcggcttcgagggcaacaccttcacccatctcggcgcggtcgggctcaacctgaacaccggtacccagggctccgacatcacgggcaacgtcttccgccagatcgccgccaccggcatccagatcggcggggtcgcggtgatcgacgctcatcccgacgactcccgggacatcaccaaggacaccagggtcgacaacaacgtggtcaccaaggtcgccgaccagtacaacggctccatcggcatcctggccggctacaccgaccacaccgtgatcacccacaacaaggtctacgacctgccctacaccggcatctccgtcggctggggctggggcctcaccgacaagggcggcaacagcaactactccccggggaatctgggcgtgccgatctgggacacccccacgaccagccgcgacaccgaggtcacggacaacgagatctacgacatcatgaagtcgcaggccgacggcggtgccgtctacacactcagcaccgaccccggcggcgtggtgtccggcaactacatccacggcataccgtcgcccgcctacggcgcgatctaccacgacgaaggcagccggtactggacgaacaccggcaacgctctgtgcgacgtcgcataccagtggctgttcctcaaccacggcatggacatcgacgccacaggcaacttcaccacccagcccgcctactccgcccaggccaacagcacgggcagcaccatcagcggcaacaccactgtgggttcctgcggccaactgccggcctccgtggtcaacaacgcgggcctccagccgagttaccgccacctcgacccgggccccgacgtcgccgaccaccaggcgccgagcaggcccggcactccgagcgcggtcaccgatttcccgacggtggcagacctcacctgggccgcatccaccgacgacacctcggtcacgggctactccgtccaccaggacggcaagctgatcagcgccaccgggaagacctcggtgcgccttccgggcctgaccgccgggaagacgtacgccttccagatcaccgcccgtgacgccgccggcaacgagtcaggtcccggcccgacactgcacgtcaccatgccctcaggcacggacctcgccctcaagaagtccctcaccgcctcgtcgtactcggagaacaacaccccggaaaaggcggtggacggagacctgtccacgcgctgggcccagggcctgggcctgcccgatccgtcctggatccaggtcgatctcggtgcgccgtacgacgtgaacggcgcgatcacgaccttcgagaaggccagcgggtacaagtaccgcatcgaggtgtcacccgacgaggtccactggaagacactcgcggaccacaccgccgcgaacaccacggcggcgaccgactacgcccacacggacgatccggtcacgggccgtttcgtgcggctgaccgtcaccggatccagctggaacggcggcagcatctacgacttccaggtctacggcactcccaggaccgtcacggaccacacggcccctacggcacccggacagcccacggtcaagccgctgctgcccggcctggtggacgtcagctggtccgcggccaccgatgacaccggcgtgaccagttacgtcgtctaccgggacggcaagcggatcggtgtcaccgacgccacgacactgcgggtttccggcctgaccgcggacacggagtactccttcaccgtcgtggcacgcgacaaggcgctgaacgcctccgaccccggcaaggcggctgtcgtcaccacgccggccgaccacgacctggccctggacaagcaggtcaccgcctcgtcgtcgtactccaaggactacgcgcccgagaaggcggtggacggggatctctccacccgctgggcacagggcgcgggcctgcccgacccgtcctggatccgggtcgacctgggcaaggacaccggggtctccagcgtggtgaccaccttcgagaaggccggcggctacaagtaccgcctggagtactccaccgacggcacgacctggtccatcttcgaggaccacacctccgacgccacctcgtcgtcagccgtccactccttcgccgacaaacccgtcaccgcacgctacctgcgcctgaccgtcaccgattccagcgggaacggcggcagcgcctacgggctccaggcgtacggcggcttctgagcactccgcttgcgagccgacacctttcacatctcgtacagaaaacgaaagccaggatgaagatcacccatgtcgaggtacaccggatcgatgttccggcagccagtccgcccttccgctggcgcgacgggctgagcggaagcgctccggtgggcgacggcgcggtcctgcacatcgggacggacgagggagccgagggagtgtcggtattcgctcgtccgggcgcctactccaccctgcgggacctggtggaccgggtctttcgtgcggaactggtcggagccgacccgttccagcgggaatggctgtggcaccgggtgtgggagctggaccgtatccacgaactcccgctccccaccctgggcctcatcgacatcgccttgtgggacctggccggccgctaccacggcgagccggtctggcgtctgctcggcggcttccgggaagccatccccgcctacgcctccacctcgacgttctccagcgtcgcggagttcctcgacgtggcggaccagtgcctggccctggggtatcgcggtatcaaactgcacgcctggggcgacgcccgccgtgacgcggaactgtgcctggccctgcgcgaccacgtcggtccggacgtccctctcatgtacgacgggtcggcgggcttcgacctgcccgacgcgatccggctggggcgggccctctccgaggccgactacctctggtacgaggagccgatccgcgaattcagcatctcggcctatcagcggctcgccgaggccgtggacgtaccgcttctggtggccgagacctccgacggggcgcacatgaacgcggcggacttcatccgggccggtgccgccaccttcggtgtccgggccggcaccactctccggggcggtatcaccggcgccatgcgcaccgcgcatctcgcggacgccttccggctgcgggccgaggtgcacggttcggacatccccaaccaccacctgtgcatggccatctccaacaccacctactacgagtccctggtgacctcggtgaacgttgtccgtgagcgccacgtggacgaccagggcctggtgcacgcccccgcggggcctggcatagcccttcctctcgacttcggctacggcaacgaactcctgccgttcgtcgagcagccgcgctgaccggcgcaagaacagaaaggcaaggaaagacaatggagtcttcccgatctccgagaaccggccggcgtcactcgctgctccgcaccgcggcagtcacgctgtccctggccaccacggccgcccttgcaggctgcgccagcgccgacaccaccacccgttcctcctccgggcagtcggcgttcaagccggccgcgcagaaggagggctcgcggataacggtgtgggccgactcgaccagactgccgtcggtgcaggcgtaccagaagtcgcaccccgacgtgaagatgaagatcgtcacgtacgacggcggagccgacggatcgacgtatctccagtcgaaggtgcagttgttcgacaggaccggcagcgggtggccggacgtggtgttcggcacgccgaccgacgtgacctgggcgtcggaggccaccaagcccgacgcgcggccgttcgccgcgcccctggacgagaagctcgtaccgcagagcaccctggacgaattcgccaagggttcgctgacgccctgtgaattcgacggccacacctactgcatgcgcaacgacatcgcgcaggtcctcctctggtacaacaagtccctcatggacaagtggggttacaaggtccccaccacctgggaggactacgaggccctcggcaagaaggtcgccaaggaccatccgggctatctggtcggctcggtcggtgacaccaactcccacgagtcgtacttctggtcggggcagtgccccgcgttcagcctggtgaagcccgacaccctgcgcaccgacctgcgggacccgaagtgcacccggatggcgaagctgctggacgacctgatcggcgccaaggccatcgccacacagggcttcttcagccagggattcgccgagaacagcggcggcaaggtcctgatggcctacggcccttcttggtacggccagtacctcttcaaggccggcttcaagactccggccaagcagatcgccgcggcgccccctctggcatggaagggagagagcacgaccgccacgggcaacgtcggcggcggcgtgtggatggtgtcctcgcacagcgccaacctcaaggcgtccacggacctggtcacctggctgaccacctccgacgagaaccaggccggcgcgcccacctatccggcctacacccaggccgcgaaggcctggctggccaacccggccaacaggaactacttcgccaatgatgtgagcgagccgttcgagcaggccgcgaacgaggtgtggaccggctggtcgaacaccaggttctcggactccaccgcctggtccagtgtcgtcctcccggctctgacctccggaaagagcctgaccgagacgctgccggcctggcagcgggagatcgcgggcgaggccaagagccagggctacaaggtggtcgatcagtgaccttgctggagaccgagcctgtcgccgtctcccccgtgcgccgcggcaccacgccgcggcgcacgggccgcggtcgcgcgggctacttcttcgtcgccggctacgcgctgctgctgctcgcgttcggcgtcttccccaccgggtacgcgttctacctcgcgctcaccaatgaccggggccagttcaccgggctcaaccagttcgtgaaggtcgtccaagactaccgcttcgccccggccttcacccacatgctgatctatctggtcatgtggctggtgaccctcgtcgtcctggtcgtgctgaccgccgtggtgctgcgcagccgcgtgcgtccgggcacatcggcgctcttccgcttcctgtactacattcccggcgccctcgccggagtggcgagcgttctggtctggctgttcatgctggaccccgatgtcagcccggtgtcctggctgctcaccgccatggggttgaagacgttcgccgctgtcctggcgcccggcaacctgccgctgatcctcatgttgatcgccttctggaccggtgccggaggctggatggtcgtgatgtacggggctttgaacaacatccccgacgacgtgctggaagcggcccgcatggatggcgcgggcccgtggcgcaccgcctggcacatccagatcccgatgatccggcagtggatcgtctacatgacgatcatggctttcgcgacgggcacccagctgttcgtggagccccagcttctccagaccgccagcctcggcagggtgagccccacctggtcgccgaaccagctcgcctacgtctacgccttccagcagggcgacttcaacggcgccgccgccatctccgtcgtcctcctcgccgtgggcctcctcgccgccgggctgctggtcgctcgctcgaacctgttcaagttggatgagaaatgacacagaccgctgtcttcctgacggccgtgaggcggcgtatccgtccttccaggaccctgcccttcctggtcgtaggactcctcctggccttgctgctgttgttcttcgtgctgccggtgatctggctgctgctgacaccgtcgaagaccgccggcgaagtggtgcgggacaaccccctctccttcggttcgttccatcagatcggcacggcctggcggcacctgttcgccttccaggacggcgccatgacgagatggctgcgcaactcggccgtctactcgggcggttcgctcatcctgacgctggccgtcagcgttccggccggctacgcgctggcgctgacgaatttccggggacgcaagacgctcctcgtgatcaccctggtcaccatgatcatgccgcaggccaccctggtgctgccgatcttcctggagctcaaccgcttccatctgatcggcaccatctggtcggtgatactccctttctccttctatccgttcggcgtgtatctggtctacatctacttcgggagcagcctccccagggacctgctgtccgccgcgcggatcgacggctgcacggagtggcagctcttctcccgcatcgcgctcccgctcgccaagccggtggtcggactggtcgcgttcttcagcttcgtgggcaactggaacaacttcttcctgccctacctcgtcctgccgaacagcgagcagttccccgtccaggtgggcctgaaccaactgctgacctcgacgccgtccttcaaccccgtcgccggcgccggactgaacgtcaccatccccgaactcgccctggccatcctcatcgccatcctgccggtgctggtgctgttcgtcttctcgcagcgcaccctggtgtccgggatgctcgccggagcgagcaaggaatgagcggcgtcgcgccaccctcttcagcacgtccgcaaaggagaccgtgtgtaccggctcgatccgcgctacgcccccgccccgcaggccgtcctccacacgggatggcaggcagtggcctcccaactccccgacggccccgtggtggtggccatcgacgggcccccgtccgtcgactggtccctcctcggtgatcgcctcgaaaacgagctgaccggacgcggtacccccgtcactctgctcgacatacggagccattacgcacggccggcacacgtcaggagccgcaccgaacacccggcggacgccgacgacccctacttccgcaggctcgccgacaatccccttgacgacctcttcgagatcctcccggtatccgcaccgccgacggaagggctgctcctcgtctacgggcccggcgccgccctcgtggagcacgacctgctctggtacgccgatgtgcccaagcgatacgcggaggccgccgtcggcgcgggtgagccgggcgtcaacctcggtctgccgggtgagaagcccgacttcaggcggctgttctacatcgactggccgatgctcgaccagcaccgcgacgcgctcgcacaccgcctcgacgcctggctcgacatgcagagccccgaccacccggcgtggatcgacggagcaggcctgcgcgccacatacgccgcgctggcccgcaagcccgtccgcacccgcccgtacttcaactccacgccctggggaggccattgggcccagcgcgagctcggattcaaccccaactgccgcaacacagcgctcggctacgaactgatcgcgcccgaggccggcatcctcatcggcaccggaccggaggaccaggccgaggtgccgttccaactcctgtgtgtgctggaaccgttgagcgtgctgggggcagaggggcacgcccaattcggcacgtccttcccgatccgcttcgactacctggacaccgtcggcggcggcagcctctccgtgcactgccacccgaaggagtcgtacatgcgggagcgtttcggctgggcgtacacccagcacgagacgtactacctgaccctcggcagcaccgacaccaaggtcttcctcggcctgcgcgaggacgccgacgtcgacgtcttccgcaaggaggtggagagggccgtcaccgacggagtccccatggaccccgaggaccacgtcctcgccttccccgccgaacagggccggctgttcatgatcccggcgggcaccccgcacgccagcggcgcgggcaacctcgtactggagatcagcgccaccccctacctgtacagcctcaggttctacgactggctgcgacccggcgccgacggcaacccgcgccccctgccctacgagcacgggttcgccaacctggagaccggacgccgcggcacggccgtcgcccgcgacctggttcaagagccgcgcaccctgcgcgagggcaccggctggcgggaggaggtcatcggcgcgctggccgagatgttctacgaggtcaggaggttcgtgctcgacgccggcgccgaggcgaccgacgacacgcagggacggttccacatcctgaacgtggtcgaaggggaaggcgtcacggtgcacacggcggccggagaccgacacgaactcgcctacgcggagacactcaccgtgccggccgcggtcggccgctacaccctgcgagcgactggcgtcggcccggtgcgtgtcgtgaaggcgctggtccgttgattccggtcctggagatcggcggcacccatgtcaccgcggcgctcgtcgacctgcgcgacgggcgtgtcaccaaccgtacgcgcgagccgctcgacgcggacggcgatgccgacgacatcctcggcaccgtacgacactgcgccgacgggctgtcggtgcctccgggtgcgcggtggggcgtggcggtgcccgggccgttcgactacgcgagggggatcgccctcttcaagggcgtgggcaagttcgacgccctgtacgggatggacgtgcgagcagccttcctcgaaggactacggcagcgccccgccgacgtcgtgttcctcaacgacgcccacgccttcctgaccggcgagtggtccgcgggcaccgtccgcgggcaccaccgcgccgtgggcatcacgctcggcaccggtgtcggctcggcgtttctcgccgacggccgcatctgcgccaacggtcccggcgtgccacccgagggtcggatggacctgaccgagatcgacgatcggccgctggaggacaccgtctcacgccgggcgatcctcgcccgttatggcgaccccgccgccgatgtacacgacatcgccggacgagccagagcgggggaggcgcgggcccggcgggtgctggacgacgtcttcaccggactgggcgtcgtgctgggcccgcgcctggtggacttcggcgcgaccgccctggtcgtcggaggctccatagcccgctcctgggacctcgtcgcgcccgctctgtccgctggcctcgtgaccgggggctggacgccgaactccccacacgccgacgcggattcactgcctcccggagcccccgagtgccccgtaggagacgcgccccctggtccgggtggcacctcggcggcaggcgcacagcgcactcgtacgatgaagcctgccggccccgcggggaacgccgcactggtgggcgcggcccgtgcggcgggggcgtgagaccgacgaagggcaggcacaagccgtggacacctggccctcggcctggccgcgctccgcgtcactatcgcgtcttagggcttgcagatcattaactcgtcttcttgaccttggtcggggtggggttggaagcgaggaacgccgcgacgtcgactggcgtgcggaagcaggcgattgaggtgttgatgtggtggccgtgtgcttccaggagtgggcggaggagattgccgcaccgctgataccgccgttccggcccaggcaacagggtggcggcacggtgccggtggcgggtcggaaggtgttcacggcggtggtgtacgtgcacaccagcggttgcgcctggctgtacctgccgccgatgttcggcacctcgcctgccaccgcgcatcgccggttcgcggcgtggaccaaggccggtctgtggcgtggaccaaggccggtccgtggcgtcgactgcactgcggcgggccgcccggatcgcctgggaagtgggcctgcgcgcggaggcgttcggcaaccggggctcgtggcgcttcggggagacagtggtctgaacgctcgtcgcccaggacccggccgtctttgcagcttctacgactcacatggtcggagaccatccccggcgaacagtaccgttcaccagcacagcaggtcagctcagggcgccggtgccgcacgggactgactgaaccgccccgcgactctcagggcaggcacccgtaccagtggcggctcagctccagctgggcgaggtctcaggccacttgctgtacggcaccggtcgccccgtggatgcgtccaggagaatgcggttgccgaccggccggcccagcttcacggtcaccttctcgccacccaactcgctggtgcaggcgccgtccttcgccccgacgacagatgcggacaacaccacgctgccgcccgtctccagcacgtccacagcgggaccgtcgtcacaggatccgtgagtggccaccacggtgacggaccgaccgtccccggcgacctgcaccagcccgcccagcggcgccagcacattggtggacatccccttggccggcttgatcggaggctcggggagcttcgacgggctgacggcgacccgcttgagcggggtgtcatagccctccagcgtgaacagccaggccgggacggtcgccggcccacggctggtggtcagggtcatctcgcccagcttcgccccagtcgcgacgaggtgcggtccgtcactgctgtcgcggtccagagccatgtacgccttctgcgcccccatcagcggcagcgtgagcgagcctccgctcccccacctcacctgcccgtctttgtggaagctggcggggaggccgccgcgcaggagaaagttgccggtcttgtaggcgcgcttgtcggcgtcgttgtgaaggccagtcccgggcagctgcaccacctcccccatcgggtagtagcccttgtgccagatctcggcggccttggatccgtcccaggcgtcggcgacctgaccggctcggaccttcacctgcggtgacgccgagttgccgtcaccgacctccgctccacgactgccgtcctccttctcgccgccgcagccagcaacggcagcaccggccaacagggcgagtgcgacgagcagatggacggtgcgtgcgctgttcgcaggcatgtatcctccaaaggctgacggtggcaaatggacgctgtgcgctgacggctggcggccctacccgccgatgtgacgcgccgatcccgggctgcgttcggcccattccgttgtccggtcgagttcgtttccgcatcgtgaccagacttctagtcgcgtgatgtccgtggcgctgcgcggacctgcaccacgcagcgtcggtgcaggtcactcctacccgcagtgaaccgccacacggcgactgcaacgaggacttccccggcttgggatactgcctggaccgagcgtcctgccctcggcaggaacaggaagtcccgctcctgcccccattccgcggagacttgtccgcacgagcgatctacagagcgatcacggcgtggtggcttcaggttcagtagacggcgaggttgtgcgtattgagcaccccctgcaccggctggtagtcggtcacgcggtcgggttgcgcgtccgtatcgccgcagggctcgtcgacatagttgccaccggacgtgattcccagggcaatagcccctgtgaacatagccccaccgctgtcgccgtacatgtcgcagaggctggtctcgatcaccttgtaaagcgtagccccggtcctgggccgcatgcgcgcctacgccaactccagctctggcacgcgttcaccaaagtgccgactcctcggcaccttcgacactgccggttgccgacagcgctgaagagcagaccgccgcgcgcagcggcgcactggcagcgctgagctgcctgagcgacgccgaacgtgaggcagtgctgctgatcgcgtgggaggggctgagccccgcgcaagccgcgcgcgccgccggctgctccacgcccgccctgactcgccgccgtgacggcgggagcgatggcactgtccggtgccttcggttccggcccggacagcggacctcgcggaccggttgaagccgaggccctgtccgctttcccgctggagaacacgaccgactgggtctcctacggcgatcacgtggcggtcatccacgtcgacaacgaaaagatcagtcccgtcccggacaaggcgaaggagcacggcgaggggcacgtggaccgcactggccgtgtcgtcatcgacaaagtcctctacaaccgctcagggtcccctgaactgccgtcttccttcaccacgcagttggccggcctgtggtgggaggacggcgtgggcacgcgggagttcaacttccgcggtacctcccgtctcgagtcagggcacagctacatcgccgtcctagtctgggacgaggatgtgcagggctttgaggccgccgcccttggcggcgtccttcccttcgacaagggcactgttggcctgggagaaatcgacggcaagacccgtcaaagcctgccgcccgactgaagtcgaaggcatggccaaggaattcaacggatccgacctctctgagatcgaagacgcactgaagcaggccacgccctaccccgccgcggcggcaaaccccacgctgcccgctgaacagcgctacgagaaagtcgtagaggcaggccaagacacctgaccctcccggtcggacttcctgtccctgctactgccgaacggggcccgggccctcttcaggatccgggccctgtcgcatgtcgggggcgcccgccgggtgtggcgcgcgatgcgcgcctacgccgccagttcgacggccggctcctgagtagctgacgctgtcggggatcttggcttccggtctgtacgtgcactgcgcgtagtgggaagttggaggacctgcggcggtcgggctggtcatcggccccatgtgttccactcgcctggggaggatcgaccgtgacctccgatcacgacctgctctggcgtcgctgcgcgcacctgggccgtgtcctgctgcctgtggtggacgaggaggcgtggcgccaggcccgcctcctcgtccaccaggaggcgtggcgccaggcccgccgccacgagcacctggaggcctggggcatcaacatcgtggaaggcgagcggctgatcgagctcttcgcggccctggccgcccatgccgtcacggtcgacatttctgcatctgccgcagaaatcgacgtcctacctccgagcgtggtggctgacgcggcaaccggtaaacgcgatctcgagctgctcgccggactcccggacaccttcgccgacggccgcgacgaactcgccgtcaaggtcttccggctgtacacctacaggggtgggcagtacagccgccggcttttccagctgagcacagaactgcgccgtgcgctgatcgtcctgcgcggcacgcgcaacgcgcggatcctcgcattcgccggctccgcgtcgctcttggacactccagcgccggtcgagcaccagcgaccgcatgccgcgcaccaccttcgaaccgcaccagtgctcatacgccgtggcgtcaagagtggccaggactacggcacctgcccgcgagctacaacacgcaaggcttcactgcggcggcgatgcctgtgatcagtagcgggatggcggcggcgtgtgcggggcacacgaagcggtgcccgggcagctccgaacgcagggcttcgtacagcgtgccacccgactcgcccctaggccggcacatcgttgtgttccagcaccgccattcccgcatcgctcggcccgatgtccgacacacggggccggcgttgggttttgggtcagcatcaaaccagcacgggagtcagcacggcaccgtcaaagcgccgcgaaccacgcaccctggacacctcctcattcaccaccggctgagcgtctctgccggaacccaacgtccaggcatgggggccacacgcacaccccgcccctgaactatggtgtcccaccacatgtgcgcctgacctgcacgttcctacggtgtccggacacgtacccgtccccaccgaacacccggaagtggtgcacatggcctccgcagcaaccgctcccccgccacccgccagcctcaagcgcatcgtcgccgcgagcctcatcggcaccaccatcgagtggtacgacttcttcctgtacggttccgccgccgcgctcgtcttcaacaagctgttcttcccgggctccgaccccctggtcggcacgctgctgtccttcctgacgtacgccgtggggttcgccgccaggccgctgggcgctctcgtcttcgggcactacggcgaccggctcggccgaaagaaactgctggtcctgagcctgctcctgatgggcggggcgacctttgcgatcggtctgctgcccacgcactcgaccgtcggcagcgccgctccggtcctgctgaccacgctgcggctggtgcagggcttcgcgctcggcggcgaatggggcggcgcggtgctgctcgtctccgagcacggagacgcgcggcgccgcgggttctgggcctcgtggccgcagaccggggcacccgccgggcaactcctcgccaccggtgtgctgtcgctgctcaccgccgtactgtcggacgcggcgttcgtctcctggggctggcgcatccccttcctgctctccggtgtcctggtgatcgtcggtttgtggattcgtctgtctgtcgatgaatcacccgtgttccagcaggcgctggcccgcgcggaggcccgcagcgcggcaccggacgccgtcgcggagaagctcccgctggtgtccgtgctgcggcaccactggcgggacgtgctggtcgcgatgggcgcccgcatggcggagaacatcagctactacgtgatcaccgcgttcatcctcgtgtacgcgacgacatcggccggtgtgtcccggcagacggcactcaacgcggtgctcatcgcctccgccgtgcacttcgcggtcatcccggcctggggcgcgctctcggaccggatcggccgccggcccgtctatctgctgggcgcggccggggtcggcctgtggatgttccccttcttctcactcatcgacacgggcggcttcggcaacatgatcctggccgtgaccgtcggactcgtactgcacggggcgatgtacgcaccccaggcggcgttcttctccgagatgttcgcgacgcggatgcgctactcgggtgcgtccatcggcgcccagttcgcctccgtcgcggccggtgcgcccgctccgctcatcgcgaccgcgctgctctccgactacggcaactccaccccgatctccctgtacgtgatcgcggccgtcgtcctgacgctgatcgcggtgggcgcggcgaaggagacccgcagtcgcgacctggccgcggtcgaccccgtgacggacgcggaacccgccgcggcacgggcagccgacgcgcccgccgtctgacccgctcccgccgaccgtctttttccccggtccttccggcccccgtacagcacacgtacgggggtcagggccgtgcgggtgacgacaaccggtgcagacgcagggccagttgtatctccagcgcgcgggccgggctctgccagtcgtcgccgaggagccggcccacccgctccagccgttgcgccaccgtgttcacatggacgtgcagttcgtccttggtgcgtgccgggctcatcccgcaggcgaagtacgcgtccagggtgtgcaggaggtcggtgccccgccgttcgtcatacgcgaccaccggcccgatcgtgcgcccgacgaagccggagatgtcccggtcgccggcgagcagcaggccgaggaacccgaagtcctcggcggcggctccctcccctgcccggccgagcaggcgcagcgcgtcgaggcatcgctgcccctccgcataggcggcccccaccacgtccgggtggtcggcgaggctctccacgggcgcggaggcaccgacggtgaccggctcgtgaacggcggtcccgagctgtcccgccgtgcgacgggccagcgtcgtcgcggtgtccccgggatcgaggggcagcagcagaacggtgccgccgtcgcgggcggcggccagtccgtgccgggtggccgccagatgggacgcggccgaccacaggcgtcggcgcgcggacgcctcctggtcggcgtcggccgccgcgccgtcgagacgggcggccaggaccacatgggtggcgtccagatcggcgtgcaaccgccaggcccgctcgcgcagcagtcgcgggtcgcggtcacgggcgtcgagcaggtcgtccagcagctcgccacggacgcgctgttcggcctcggatgccgagcgtctggcgagcagcaacagtgaggtgaccatcgcggcgcgctccagggtgcgctggtcgacggggtcgaggcccggatggccgcgcagcaccagcgcaccgaggagctccccgccggccgccacggcggcgatccagtcgtccccgtgccgcacggcgtggccctcggcgcgggatgcctccagggccacggccggtgtgaccacggcctcggcgaactcgaccgtaccgtcgagcacttgggagaccgccgcggccacgtcgtggacgccgccaccgcgcaggacgagctcggcgagccggtcatggacgtccgacgcgcgctcgatcactccgctgcgatcccggatgatctcgttggcacgggcaagccggtccagtgccgagcgggtctcggtgagcaggttggcggtgtcgatggcggcggcggccagtgcggcgaacgagccgagcagcgcgatctgttcgcgttcgaagacacgggcgcggcggtccgcggcgaacagcacaccgatgacctgcggcccgatcatgaggggcacgccgaggatcgccaccagcccttcgtcccgtacgcccccgtcgatgacgcgggtgtgctggaagcgctcgtcgttgaagtagtcgggggtcacgtaggggcgggcggtctgggcgacgaggccgccgagcccctctcccatcccgagccgcagttgctggaagcgcgcggcgaccgagccctcggtgaccctcatataggtgtcgccctcagcctcgtcgtgcaaggtcaggtacgcgacgtcggtgcccagcagcgaccgggcccgctggacgatcgcctgtagcacggcgtcgaggtcacgcagtccggccaggtcatgggctgtttcgaagagagcggacagctcggcctcacggcgccgtctgccctccatctccgagcgcacgcgcagcgcgaggcgcttggtccgctccagcgcggcgacccgctcgggagacaggccctcggcgcgggcgagaagcaccggctgctcgtacgcgtcggcggacgcgccccgggccaggagctccaggaacggcgccttggggccggtggccgctgcctcgccggagcgctggggggactgcacgtgatcgcgagacatgttcacaggatgacccaaggtcgggccggcgccgccggccctgtggacaactcaggaattccgagctgctcagtgtgcggtccagccgccgtccagcgccagcgacgtaccggtgatgaaggacgcctgcgggctgcacagataggccaccgcctcggcgacctccgccggctcgatgagccgcttgaccgcgctgtcccggagcagcacctcggacagcacgcgctcctcggggatcccgtgcgccgctgcctggtcgacgagctgtttctcgaccagcggggtgcgcacataggcggggttcacacagttcgaggtgacgccgtgcggcgcgccttcgagcgcggcggtcttcgagagcccctccaggccgtgcttcgccgccacgtacgccgatttgaacgccgaggcgcgcagcccgtgcaccgacgacacattgacgatccgcccccagccctgtccatacatgtggggcagggcaccgcggatgagccggaagggtgcctccagcatgaccgtcagcacggtgtggaaggcctccggcgggaactcctcgatgggacggaccagttggagcccggcgttgttgacaaggacgtcggttcccgcggcggagagttccgcggcgtccagatcggtgaggtcgaggacctgaggctcgaccgtgcccgcgaggccccgtgcggcttcggcgagggtgtccaggccctcggggtcgcggtcgaccgctctcaccttggccccggcggcggccagccgcagcgcacaggccctgccgatgccgcctgcggcgccggtgaccagggcggtccgaccgccgaggtcgagggaggtggcgtgcgggccggggaggaccaggggcgcgttcatgccttgaccctaggcagcggccccgccccgaccgatgtgctcagagcacactttttgccctcaggtcatagggtcgaaccatgtgggtccatccgacagcgcctgcttgatccggagcagcccgaactcgttcagctccggcagggcgtccaacgggaaccagccgacctcgagtgactcgtcgtcgttgacgcgcgcctcgccgccgacggcccggcaccggaacgtgatgtccatgtactggcaggtgtcaccgttgtcgtacgtcaccggctccagggcctgcacaaggacgacccgttcgacgacgcaccgcacggccgtctcctcgtacacctcccgcacggcgcaggccgcgggctgctctccggggtcggggatgccgccgatcaccgaccatgtgcgggtgtcggagcggcgccccagcagcaccctgccgtcgtcgtcgaggacgatggcggtgactccggggagccagagcagctggtggcccgcggaggcccggatggtgcgtatgaagtcgggagtagccatgccccgaccctaacgggccggtcccgtccggcgtgcggtccgggaacgtcagccctgaagggcgtcgttccgccgcccgcggaccacggcggcgaccgaccagccgagcccgcccgccgccaccagtaccaggaccatctcgggcaggatcccgagccgggtggcaggggtctgggaggagcgcagcggcaccttctgcacgagtgagtcggccacgaacatcccggtcttctgcgtgatcttcccgtccggcatgatcacggcgctcacaccgctggtcaccggcaccgtgacggtgcggctgtgctccacggcgcggacccgggacatggcgagctgctggtaggtcatctcgctgcggtcgaacgtcgcgttgttgctgggcaccgagatgatctgcgcgccgtgggtgatgttgtcccgcaccgcccagtcgaacgcggcctcgtagcaggtggcgaggccgaccttggtgcccgccatggtgaacacgcccggctcggtgccccggctgaagtcctggcgcaccatcgaggtccagttcttgttgatggcgccgagcagcgagcgcagcggaaggtactcgccgaacggctggacctgccgtttgtcgtacgtgtccagggcccccttggcggggtcccacaggatctgttcgttgtagagcttgccgtcccgttcgacgacaccgccgaccgagatggggacgccgaccgccttggccgcactgtcgatcacggcacgcgcgtcggggttggtgaacgggtcgatgtcggaggagttctccggccacagcacgaagtcgggctgcgcgaccttgcccgccttgatcttcgcggccagacgctcggtctcgcgcgcgtggtggtcgagcacggcgcgccgctgggcgttgaactcgagccccgagcgcggcacattgccctggatgaccgcgacggtcgcggtgccgtcctcggccttgtcgctgaccagggaccgggcggcgagggcgcccaccaccgggacggccacactcagcagcgccacggcagcggccccacgccgtacgactccggtgcggcgcccgtcgacgacctggcgcacgatctcgtacagcccgaaaccgcacaggacgacggcgaatccgaggaccggggtgccgccggccgcggcgagcggcaggaagacaccgtcggcctggccgaaggcgatcttgccccaggggaagccgccgaacggcgcacgcgcgcgtgccgcctcgcccgcgatccacagcgcggccgcccacagcggccaggcgggcagccgcgacaccatggcgatgcccgcgccgacgagggcgacgaagaccgcctccaccacggcgagcgcgagccacgggccggggccgacctcgacgccggtccacacgagcagcggcagcaggaagccgaggccgaacagatagccgaggccgaggcccgccttccaggtgcggtcccgcagcgcccagcccaaaaccgcgaacgccggaagggccagccaccacagggtgcggggcgggaagctgacgtacagcagcactccggagagcgtcgcggcggcggccggaacgagtcgccgtacccgtctggcaccgcgcgacgcgggcgcggcctggggttcgagctgttccggctcgtctacggaggttgcggtgacggtcactcggggagtgtacggcgcgtgaccaagacgcggacagcgcggtccgtgcggcggcgaccgctgctgccgacacctcaggcgcatcgtttctgcgcaactcatccacaaaccggcgcatcacccgttacggtgtgccccgagcctctgacgtgcggccggatgcggccggaccggccggggcccgtcacaggtcggggggcggctgggtggggtccacggggacggaagcggcggccggtacgacggccgccgacgacagacgcaacgtatccgacgcgacaggcatcgccgtactcgccgcatgtgccacctggtcgttggtcacggccgccgcacggggcggtcggcccgaaggtgtcctgctcgcggtgctcgccgtctccgccggctacgcctcggggcggatctgcggggcgctcctgccggtcgcgacgccctgcgccggggcactggccgggctcggtctggtgctcgcggccccgcacggcacggcgggcctccagggctcctcgccgctcggccctgcgggcgcgaccgccgcgctgctgacgctctgcgcgggagcggcgtgctgcgcggcgtgggcggcgcgtccttcggcatcgcggctcgcgctgcggctgctggccgccgccatcacggtgaccgcggcggctctcggttccctgaccggcttcgcggcctgcgccggagtgctgctctgctcgtcggccgccgaccggatgcggcgccgtggcccggggctggcctgcctggcgctcggcaccgcgctggtgagcgcgacagcctgggcgatcgccgagaacgtactgcctgccgggctgaccacggccctggaaggccagctcacagagcgccggatcctgttgtggcgcgacgcgctccgtctggcccgccaggatccggtgctcggcgcggggcctggacgcttcggggagctgagccctacggccgcgcagtcgctgctgcccgacggcaagccgcattccgcgccgctgcaacaggcggccgagcagggtctgctcggcgtggcactgctcgcggcagtgttctgctgggtgctgtacgcgctgtggcgcagcccgcgcgccacgccgatcgcgctcaccgcgggcgcctccctcaccgcgctggcggccatcgccacggtgggggacgcactgagcttcaccacggtgacggcgggagcggggctgctggcggggatcgccacggcacggccgcttctcagtggggaggcggaaggcgagcgcggggcggactgaccgtcttcggacgtctcggggctcagtgcggcacggccgcaacgctcgtcagtgcgcggcacccggaatggtcgagtgcagccggtcgcgaatgatccgtaccgccgcttccgcgttgtccaccgtgatggtgaacgtgtggccgtcccagaggcgcagcaccacgccctcgccgcgacggaccacgaccgcggtgcccttctcgggccgccagcgatagccccagccaccccactgacacggggtgacgcgggccacgaactcggcgcccgcgacctgcgcgagagggatacggcggcgcggcagaccgatatggccgcagcgcacttccaggcagtcctggtcgaccttcaccgcgacgtgcacgaatgcgagcgtcccgaagatgaccagcagtccggccgcgatgcagcccacgacggccatcacgagcggggcgatgcccgacgtccacgccgagtcgacggccagctcgacaccgagcgccaggaaggcggcaccgccgagcgccagcagccattgggcacgattggtcgcgcgtcccgtccagacctcggtgagcgggacgtcttcgtcgtgggggtggtccctcatacctatgagactactcaggttccgcaccgcgggcaccgggttgctcagtgtcactgctccgggtgggcggtcgggagacccagggcgcccgcccggtcacggccggtcacccggtcacccggcccagggcggggtcggtcaacgcgctgtgctgagggtctgcagcagctggccttcctcgtacgcgagtgccggtgcgggcagcgtttcctcgcgcccgccgaggagcacggtgagggaggcgcccatgggtgcctcgggcgcgggcagctcgccgatcctgcgcagcgcctgcgcggccaccgctcctgcggaaccgtgcaggacgagcggcggaaggcccggcttctgcacggcggcgcgaatacgctcggcgacgagttcgtaatgagtgcagcccaggacaacgacccttacatcgtccggggtgcgctccgcggccgcggcgatcgcggcgtcgatggccgcttcgttcgcgtgctccacggcgtcggcgaggccgggacacggcacctcggtgaccgccactccgtcggcgaactcccgaatgagaccgcgctggtacgggctgccggtggtggcgggcgtcgcccagatcgccaccggaccgccactcgccgcggcgggcttgatcgccggaacggtgccgatgaccggcagtccgggttcgaagcgggcccgcaacgcgggaagggcgtgcaccgacatggtgttgcaggcggcgatcagcgcgtccgggcggtgcgcggcggccgcctcggcgacggcgagggaacgttccgtcacgtcctgtggagtgcgcggtccccacggcacgctggcggggtccgaggagagaacgagatcggcgtcgggccgcagtcgacgtaccgcggcggctgccgcgagcagcccgattccggagtcaaggagcgcgatcttcacccggtcaccatagacgatcggcctcgacgggcagccgtggtggggcagactgcggcgggtgagcgccgttgtgtggatcgccgccggatcactgaccgcctggctgtggctgctgctcggccagggcttcttctggcgtacggacgtgcgtctgcccccacgcgtggagcccgccgactggccgtccgtcggcgtcgtggtgccggcgcgcgacgaggccggcgtgctcccggacagcctgccgtcgctcctcgcccaggactacccggggcgtgccgaaatcttcttggtggacgacgacagctcggacggcaccggggccctcgccctggagctcgcggagcggcacggcgggcttccgctcaccgtcgactcccccggcgcgcccccgccgggctggaccggcaagctgtgggccgtacgtcatggcatcggtctcgcacgcgcgcgtgaccccgaattccttctgctgacggacgccgacatcgcgcacgcaccggacagcctgcgggagctggtggcggccgcgcgtaccggcggcttcgatctcgtctcgcagatggcccggctgcgcgtggagagtgtgtgggagcggctggtcgtgccggccttcgtctacttcttcgcgcagctctaccccttccgacggatcgggacgaagggggctcggacggccgccgccgcgggcggctgcgtactgctgcgcacggacgccgccgagcgggcccggattccggacgcgatcaggcacgccgtcatcgacgacgtggcgctcgccagggtggtcaagggcgacgggggccacatctggctgggccttgccgaacgagtcgacagcgtgcgcccgtatccgcggctgcacgacctgtggcgcatggtctcccgcagcgcgtacgcccagctgcggcacagtccgctgctgctggtcggcaccgtgctgggtctcgtcctggtgtatctcgtcccgccgggcgctctcttcgtgggcctcgccgcggggagcgcgccgacgatggcggcgggagggatcgcatggctggtgatgaccggaacgtacctcccgatgctgcgctactaccgccagcccctgtggctcgctccgctactgccggtgaccgcgttcctgtacctcctcatgacggtcgattcggcggtgcagcactaccggggacgtggtgcagcctggaagggccgcacctacgcccgtcccggcaccgccttcgaggaacggtgaccgtgccggtcgggcggtgacgggtcacttccggccgggggtccagttcatgccccacccgtaggcgtggtcgatcgtgcgctgcgggctgaccccgcgctccgggatcagatagcgggcctcgcgctggacgagcaggtcggcgccggtgttggtgatgagggccagcgcgcacacggtcgaggggacggtgcactcgtcgagcgagaagtcgaccgcggccccgttctgcggctgaagggtgaccgtggcgtgcaggtcggcgaaggagcgggcaccttcgtagatggtcacgaagacgaggatgcggcggaagctctgcttgtggtcgaggttgacggtgaggttctcgccgctcgccacggcgccggagcggtcgtcgccgtcgagatggatgtacgggggccggtacagcgaaccgaaggcgttgccgagcgcctggacgactcccttgcggccgtcggacagctcgtacagggcgcacaggtcgaggtcgaggtccgcgtgcgtcgcgacggcccggccgcgcttgccgccccacccggagaactgcttgcgcatctgccagttgaggttcacgcgcagggcgccggacgtaccgccctgcttggtgagcgagaccgagggcgcctccttggtgagcgtgaccttgctcaggcgcaccggggtcggggaggcggcgggcggcacggtcatcggcgggggcggcaggggcacgggcgggccggccggcggaggggcggcggcctgcggggactgtgcttcggcgggccggccgacgcgagtatgccgtggggtcggcaataggtgctgcggctcgtccacggtgatgccgaagtccttcgccagtccttcgagtccgcttccgtagccctgtcccacggcgcggaacttccaggcgccctgacggcggtagaactccccgaggacgaaggctgtctcgacggtcgcggtggggtcgaaacgggcgacctcggagccctggcgcgcatcgacgacgcgaatgtacaggcccggcacctgcccgaacgttccgccgtcggcggaggcggcgagcaccactctctcgatggcgggctccacgcgtgcgaggtcgacgaagagcgtgtcggtcacctgaccgcccgcctcccgcgttccctcgtgccgcaccgcgccggaggagtgcgccggctggttgtagaagacgaagtcgccgtcagaacggacctttccggagacgagcagaagcgccgaggcgtccacgtcgggcccgcccggtcctgagcgacggcccacctcgacgcgcagcgcggtcgtcggcaccggaatattcgatccttttggcattgtcatgtccgcccccatcacgtgccgccgcgccaggcccgcgccttgggcagtctgtcggttccgtaccggtcaacttaatcccccagggccgtgaactccccgcctcatacccggaccgagacccaccggaagatcgccggccgaccgcgagccaaccatgagtcaaccgcgagtcacaggaggtcaaccgccggtaacccgccaggaactcggcctttacacgatttgaacctcgattgccgcccttttttgacgtgttcgctcgcattggggatcccgcgtcactgccgacacggaaaacaaccctcttatcggtctccccaaccagcacatcgtgggcttaacttatgtgccatgacctccccccgctccacctatggcggcggttactactccgcgtcgcccttcccggacactccgatctacgactcgctcgtcgccgagcggggcaccccgcagatcgccccgatccgggtcccctccgcttatgacgcgagcaacaacctgcccgcgctcccctcggctctgcccgctctgccggccggtccctcccagcaggtccccgcctacggatatccgcaggcccaacagcccgccccgctgcagcaggcgcccaccgcctacatcccgcagcaggccgccgccccgcgcggctacccgggcgcccagccgcagcagccgcgcccgatggcggccggcacgggttacgaggcgatgcgccccgcggccccgcgccccgccccggctccttaccaggacccgtacaacaacggacagcagtaccgcggatactgagcagttcaccccggactgtcggtgccgcctggcacgatggtcgtatggggaacgcggagctgcactcgattcacatccatccggtcaaggcgttccggggccagtcgccccgggaggccgtcgtggagccgtgggggttggccggagaccggcgctgggtgcttgtcgacgatgggggcaaggtcgtcacccaacgccaggaaccacgcctggccctggccaccgccgagctcctgcccggcggtggcgtccggctgtccgcgcccggacacgagccggtctccgtccctgtgccggagccggccgtcacgacgacgctggacatcttcggcgacaaggtggaggcagtcgtcgccgacgacaccgcacatgcctggtgcagcacctatctgggcgccgacgtgcgcctcgtgcacatggacgaccccgccacccgccggcccgtcgatcccgactacgcgcgcccgggcgagaccgtcagctttgccgacggctatccgctgctggtcaccaccctcgcctccctggactccctcaacgacctgatcgcacaaggtgatcatcccgacgagggcccgctgcccatgaaccgcttccggccgaacgtcgtcgtggcgggcaccgcggcctgggccgaggacgactggtcacggatagccatcggcgaggtgaccttccgggtcaccaagatgtgcgggcgctgtgtcgtgaccaccaccgaccaaagcaccgccgggcgcggcaaggagccgctgcggaccctcggccgccaccgccgcttcggcaaggacctggccttcgggcagaacctcgtgccggaaagccccggcacggtgcgcgtcggcgaccgtgtgcggatcctcgaatagtccgctcacgtggcctgccccggccggttcgaccggccggctcgaacccgatcgccccgccggtttccccgattcggggcgcgcacggggaacccgggccccgggcacggtcgttgggactcgatgagaagttcgtgaaacacccgtggggcggagaggggtgatctcgctctctcttcccgtgacccgggcatgcgcagcccgggcctgggttatcacggacgcggaggcggaagggggtgcgggacgatgcgagcgatcggaggcctctggcgctggcggcacaatccgctgcgccgtacgaccgacctgatcgaggcctgggtgacgctgaccgccctcctgctgatcctcgtcgccgtgcccgtcatcggtgccgtggtcggagcggtcgcgcaggacgcccttcagcagtccgtgcgggaccagcaccgggcccggcacgaaacggtggccaccgtcgtcaagaagctcaaccgcggcccgctggaccccgatcccgagacctcgtcggcgcgggacgcgcacagccgcgtgctggccgcctggacgggacccgacggctcggcgcaccacggcgcggtgctggcggacctcaagaccccgcaccgcggcgaccacttcactctctggaccgaccagcagggccgcatggtgggccgcccgttggacaccgccaccgcgacgacgcacgccatgctggccgggttcggcgcggccgcgatgtcggcgggactcgtcgaaggcggcagacggctgatcgtctggcgcatggtccgccgcagatatgcccgttgggaccaggcgtgggacagggcgggcccggactggggcaggaccggcgccggcagctgacggccttccggctccggtcaacccgccgtctccgcgcacgctacggtggaccggccgaactgttcggcatcgacccgcgtacgacgaggtgggggcacagcagcgccatggcacagggcacggtccaggtgacgcacaccggcacgtcgaggtggcgccgccgtacgggtgagtacgcatcgctcgccgccgccctggaggccgcgggcgacggtgacgtcctcacggtcgctcccggcacctaccgggaaaacctcgtcgtccagcgggcggtgacgctgcgcggccccgagggctcccccggctccgtgcgcatcgccccggtggacggggtgccgctgaccgtgcgcgcctccgccgtggtccaggacctgcacgtggagggccaggacgcggccgcgcccgcggtcctcgtcgaggagggcacgccggagctgatggacgtgcggatcgtcacgcggtccgcggtcggcatcgaggtacggggcggcgcgcgccccacggtgcggcgttgcacggtcgacaatcccgcgggcatcggcatcgccgtactggacggcggcggcggggtgttcgaggagtgcgagatcgtggccgcgggccagtcgggcgtcgcggtgcgcgggggcggccatccccgcctggagcgctgccgggtgcaccacgcctcgggcgccggcctgtcggtcaccggtgagaactccgccctggaggccgtcggttgcgagatctacgagatcaagggctccggggtgcaggccaccgggcgggccacggcacatctcaccgactgcgatgtgcaccgtacgacggcggacggcgtcacgctcgacacggacgcggtgctgacgctcgccgactgccgcatccacgacgtccccgagaacgcggtcgacctgcgctcacgctcggtgctcacgctgacccgcaccaccgtgcggcagttcgggcgcaacggtctgtccgtctgggacccgggcacccgcgtggacgccaaccagtgcgagatcttcgacagcacgggcgactatcccgcggtctggatcagcgacggcgccaccgccgtactcgaggcatgcagggtgcacgacgtgccggacgcgctgttcgtcctggaccgcggctcgcgtgcggacgtcgtcgacagtgacctctcgcaggtgcgcaacacggccgtgtcggtcagcgacggcgccaccgcgcagctcgacgactgccgcatccgggacgcggcgacgggcgcctggttccgcgaccacggcagcggcggcacgctgtcgggctgcacggtggacggcacacagacgggtgtgatcgtcacgaagggcgccgaccccaccatcgagcgctgcacggtgacttcaccggccgaggcgggcttctacgtgtccgccgggggccgcggcagcttccacaactgccgggtgacggacagcggcggctacggcttccatgtcatcgacggctgccgtgcgacgctgaagaagtgccgcacggagcggtgcgcgcgcggcggctacgagttcgcggacggcgggcccggcgcaccgggcggaggcggtgcgatcgtcgaggactgcaccagcgacgagagcgccggtctgcgtcccccggcccaggcgaccgccgtcgagacgaccagccagtcgcccggcctgctgggcgcgatccccggccagcgcatcaccgagcacgaaccgcacatcgcggccgccccggagcccgagcagccctcgcgcacgtcgaaggcggtgctcggtgagctcgacacactggtcggcctggagagcgtcaagcgcgaggtccgtgccctcaccgacatgatcgaggtgggccgccgccggcagcaggcggggctcaaggcggcctccgcccgccgccatctggtgttcacgggctctcccggcaccggcaagacgacggtcgcccggctctacggcgagatcctcgcctcgctcggcgtcctggagaagggtcatctcgtcgaggtgtcccgggtcgacctggtcggcgagcacatcggatcgacggccatccgcacccaggaggccttcgacaaggcccgcggcggggtgctgttcatcgacgaggcgtacgcgctgtcccccgaggactcggggcgcgacttcggccgtgaggcgatcgacacgctggtgaagctgatggaggaccaccgggacgcggtcgtggtgatcgtcgcgggctacacggccgagatggagcggttcctgacggtcaaccccggtgtggcgtcccgtttctcgcggaccatcaccttcagcgactatgggcccgaggaactgctgcggatcgtggagcagcaggccgaggagcacgagtaccggctgacgcccggcgcgggcgaggcactgctgaagtacttcacggcgattccgaaggggcccgcgttcggcaacgggcgtacggcacggcagaccttcgaggcgatggtcgagcggcacgcgggccgggtcgcccagctcgacgagcccagcactgacgatctgaccctgctctacccggaggacctgccggagctgccctgatctccggcgccgccctgatccccacccacgtcctgatccccacccacgccctggtccccggcggcgccccgggcgcgcggtcccggcacgtccgggcgcaaccgcgccagcagccgctcccgttcctccgcgaacgccggatccgcctggtagcccccgtgcccgaggatcggcgcgggcagcggatgctcctccgtgcggccgtaggcgagcggatcccgcagcggggcccggtcgacctgcgggccgcagtcaccgggcagccggacgggcccgccgatgggatcggtgagccggtacagattgcgccagcagtcgacctcgcggtgcagggcgctgagggccgccggaccgaagtgggcgggaaaccagcgcccgtacagccgctccagcggagacccgtacgtcagcagcccgaccctcctgcgttccgagggcttcagctgccaggccgcggcggccgcgagcacgctgccctgggagtggccggagaggacgagccgtccgcccgtcgcacgggtccaggtggccatgcgccaggtcaggtcgggcacagcccgctcggcgtagcagggtggggcgaaggggtgggcggcacgcggccagaacgtgccgacgtcccacaggatgccgatggtgcgccgcgcggcggggtccttgtaggcgcggcggccccaggtgacgaagagtatgaagccgaagctgatcagccaggagccgagcccctgcgcggtgtcggcgctgccctggacgaaggagtacgtgccgcgggccgccctgccgggaacgtcaccggtggccgcggcgccgaccagggcggccgcgcccaggagcagcgtcacggtggacgtgatgcccacgacgaggggtgcccggtcggtgagggcggccatcgctcgggtgctcgcgatacggcgggtgcgggtcgtgtcctgcggctccccgtggtggtcgcgctccacggcgtccatctcggcgcgccgcagcagccaggtgcgccgggccagccaggcgaacagcacgagcaggacgatcagcagcggcgggatcgcggaggcctgccaggtgagcaggacgggcgggccggtcatgacacccccgctgccgtccagccagtcggcgacccgctgggagatgcctccggacatcacgctgccgagcgcgcaggccagcatcgcgacggcgggtccggcgaggccgcgcatcgcggtgcgcgcttcggtgggggtgccccctgctggagcggagccgacagcctgggggagggtgcggtacagcacccgggcgaccaccccgagcgcgatcacgaccaggccctgcgtcaaggcgatcccgccgaacgtcatgtcgccgggcagccggcccgtcgagtgccagccggggcgggaccacccggcgtacagcatggtgagcgcgagcagcgcaagggcgcccctgggcagccggcgcaccagtgttccgtcgagttcccggtcgagccggttctcggtgcggcccctgcggcagacgacccagaccacaacgaccgcgcccccgacaagagttgcggcgagaagcccggccagccattggagggcggccgggccgccggcccggctgtcgtgacggacggcggaggcgccgaccgccgcggccacggtcagaaagcccgcggcggtgtgcgcggcgcgcagcctggccaccaggcggcggccgtaccagaagcccgggcggccgagggccgtgcggtgggtctcttcttcgggctcggcccggcgggagatcggctgctgggactcgtacgcgctccaggtgcggtgggagaggtaccagagcaggccggtgagcgcggccggtgccagggcggccagggcgaggcggcgtccgggctggctccaccagccgccggaggcgacgggtgacaggaagcccagccaggagtgcttctcggcgcaggcgtgcgtgccggcgcactgccaggcggcgaggtccagtgcgacctcgcaggcggccgccaccagcagcacggtgagggtgaggccgatgagccggaccagcagcccgtacaggcgcaccgtccgcttccggccgcgcgtcgcgggacgcatccagtgcgcgaggttgatcaccatgaagggcagcagcaagagccacagggcgcgggcgccattcccggaggtgaggttgcaccagacgtacgcctccgggaccggggtgccccggtggtcgccgggccgccgctccgcgtcggcgtcgtcggcgcgccggtagaccgccgcggttccgtcgccggtgatccgcacggtccgcggatcgttcagcatctcctcgggtgtggtgccgccgactccgtggaccagcagttccagagcggtcccggccgcttcgggccgctgggtggagtctccgcgctcccccgccgaggcatgttcgtgtgcacgctccactgttccgcacttcccccgtgcccctatggcgtgtgtcatgtgcaggcacaggatctccgctgcggcacgcccgcacacctgtagtcgccgaatctcaccgatccgtgtgaaagtggcgggcggaggatcatgatgtgaggtgcacgggcgatggcgcggcccgcggtgccccgtgcgaggatggggcgtcctccggggccggtggcggggcgaaggtcctcgtgggagccggtgctcggggcgtgtcgggtgtactgaggcgaaaggaccggagcggacgtgagtgagaatcagaacctcctcgcggagcagcgtcgcgccctcatcctcgacgaggtgcgaaggcgcggcggcgtccgtgtcaacgagctgacccgcaagctcggcgtgtccgacatgacggtccgccgcgatctggacgccctcgcccgtcagggtgtgctggagaaggtgcacggcggcgcggtgccggtggtcgaggcgagcacgcacgagcccggcttcgaggccaagtcgggtctggagctgacggccaaggaggacatcgcgcgagccgcggccgagctggtcgcaccgggcacggcgatcgcgctctccgggggtacgacgacgtacgcgctggcccatcagctcgtcgacgtgccggacctgacggtggtgaccaactcggtgcgcgtggccgacgtcttccacgcggcgcagcgcacttcgggtcagcggcagggcgccgccacggtcgtgctgacgggcggagtgcgtacgccgtccgactcgctggtggggcctgtcgccgaccaggcgatcgtggcgctccacttcgacgtgctgttcctgggagtgcacggcatatcggtcgaggcgggcctgtcgacgccgaacctggcggaggcggagacgaaccggcgacttgtgcagtcggcacggcgcgtcgtcgtggtcgccgaccacaccaagtggggcacggtgggcctgagttcgttcgcatcgctggatcaggtcgacacgctggtgaccgacgccggactgccggccggggcgcgcgcggaggtctcggagcacctgcggcgtctggtggtggccggggagcccggggacggtacagacatctgacggcccgccagctatggtgacgctgcccgcgccgcgccccgtggtgggggcccggccctgtcaccgttcgcttccgctcgggaactccgtttcccgcaagggggtttcgtccatggcacgccgtctgcgcccggtcgggctcgacttcactcagatcgctcccgtgtgtctggtgttcgcccgcgaggtggccgcgcccccgaagacggtcttccgtgcgctggcggaggacgtcgggggctggagcgagtggttcggcgcggtcacctccgcccggccggtcgaggacggcgccgggcgggaggtccggctcaagggcgggacccgcttccgggagacggtcgtcgtggcgaaaccggccgaggtgtacgcgtaccgggtcgacgagacgaacgctcccgggatgtccgcgctcctcgaggagtggcggctgacgccggccggtacgggcacccgggtgcagtggaccttcgcggccgacgggcccgcggtcttccggttcgtggtgaacctggggcgagcgggtctggggcgcgcgttccgggacgcggtgacctcgctggaccggcggctggcggccacgcgcgcgtgaaccccctgcgacgctgtccggccgccccgcgtgcgcgcgcggggtccgcggctcagtcccgccagacccccgtcgccagcagcgagtcgatcgccgccgtgtacggcgcgatgtccagcccctgctcggccagccacgcgtccgagtagtacttgtccaggtagcggtcgcccgggtcgcacagcagggtcaccacgctcccccggcgcccctcggcgaccatctccgcgacgatcttcagggcgctccacaggcccgtgccggtcgagccgccggccttgcggcccatggcctgttccagggcgcgtaccgcggcgacgctggccgcgtcggggaccttcatcatccggtcgatggcgccgggcacgaagctgggctccatacggggtctgccgatgccctcgatgcgcgagccgcagtcgcaggtgacgtccggatcgccggtcgtccagccctcgaagaagcacgagttctccggatcggccacacagatgcgggtgtcgtgctgcatgtagtggacgtagcgggcgagggtcgccgaggtgccgccggtgcctgccgtggcgacgatccacgtgggctccgggaaccgctccagctccagctgacggaagatggattcggcgatgttgttgttgccgcgccagtccgtggcccgttccgcgtaggtgaactggtccatgtagtggccgccggtctccgcggcgagggcggcggactcctcgtacatcttgcgcgagtcgtccacgaagtggcactgcgcgccgtggaactcgatcaggcggcacttctcggcgctcgtcgtgcggggcatgaccgcgatgaagggcacgccgatcagcttcgcgaaataggcctcggagacggccgtcgagccgctggacgcctcgatgaccgggcggccgggccggatccagccattgcagagtccgtacaggaacagcgagcgggcgagccggtgcttgaggctgccggtgggatgggtcgactcgtccttgaggtacaggtcgattccccactcctcgggcagtgggaagcgcagcagatgcgtgtcggccgagcggttggcgtcggcctggaccttacggacggcttccttgagccagctccggtagtcggcgtcgctgtggtcgacatcgagggtttcgccgggatgagtggtacggggagtgctcacggcggggctccttacacggtgtgccgacgccgcgtcgcgcggtcggacgcctcgatcataaacaccttccgcacgcttctcacctgcataaacacacctttgagcaccccaaaggcacccctggggcaggggtgcgccgggtggtgggggcgcatccgcgcgagtgcgccggatacccgcccccacctcgccgtgcgtactggtgctcgctgccgggggcgggcagactgcaccgcaggggacgtcggttccgaacgcgggcgcacactggagcacgaccacactcgatcagggcccgcctggatcacgacccgacgcgggatccacggcacggcacaggcgaagcgcacaagggggcggagcatcatggcggagccggagttcacggccacaggcgtgcggatcgggaagaggctgcgctcgctcacccgggccgggcaggtccggatcagcggcggcaggcttgagctgctcaccagctacggcagcgagatcgacagcgcgccggtgcaggcggtgcgcgcgtcgaagccctggttcgcccctgaggaccgggcgttggcggatgtcaacggcacccgctattcgctgaccctcggcgagcacgatcccgcgcccgggaagccgggtccgccgtcggcacgccggttcatagaggcggtccgcaaggcgtccgggcgccgtagctgagagtggcgcgagttgcaggagtgcatcccctgggccacgctggtctcacctcactctgggtgtaccggcgataacgctgcgaaccagcccgccgggtcatcaacagcgggcggccgacgtacgcagccgctccacagcagacagccggaatggccggccgcctgctcagcaggcggcgttttcacgcagccaccctgctggatccgatctccgtcttcttccggacctcaattcggggagtcgcagccgtgatcagcaaaccaagcaggcactgcacggtagagctccaagcccttccgtcgcggatcggccaggtccgcagaatcgtctctgcgcagttgcgctactggcatctcgaccccttgatagaccaggccgcactcggtgtgaccgagctgctgtccaacgtccaccgccatgcccagcccgacaagacgtgcatcgtggagatggagctgctgctggaccggctcacggtctcggtgcacgatcacgacccccggctgcccgtggtgcgggacgcggaaccgtcggccacctccgggcgcggcctcgccatggtcgccgcggtgagcgagagctggggggtgcggccggaaggcgagtccgggaaggtcgtgtggttcacgctcccggccccctccgcgacggcgctgcccacacgtccgccgcgcgacatcggccgacccgtgcccgttctcaggcgcgcggtcgacgggcgcaggtccgaacacgctcccgcccggtccgccgttgccggctgaccgggcggtgacccgtcgctcgtacctccggttgccgtgcctcgtacgtccctcatgtggacgtcggggccggccgcgcccgtcggatcattccgtggcgccgacgcgcggcacgtgcaggcgtggccgcccgtcggcagttcggccgatgagcggttcgagatagcgggccacgttgccgcggttacggctgccgccgacgtcccggggctagacggatgccgcgccgcccttgcccaggcggccgaactgctcgtccaggacggagagccgacgccagtactcgtcctcgtcgatctcaccggaggcgaagcgccggccgagcacggcgatcggcgagtcgcccgtcgggcggccgtcgcccatggcgccccacgctccgccaccccacggtccgccgcgtccgcgcctcacggtgcggcgcaggacggtcacgacgccgatcacgacggccgcccagatcagcgggaagaacggaatccacgggccgggcccgccgtcccagttcgccagggtctgcatctcgggtcatctcctcggtggggttctcctgtgatgtctcgagaatggctccgggagggggcccgggtcgtcgtacggccgacggcggtgcgcgtacctcccggggagtacgggcgctattaaggcctcgacgtctgtacctactagtatgtacagtcacggtatgagcacccaggagcgactgatcgagtccacccgcgagctgctgtgggaacgcggttacgtgggcaccagccccaaggcgatcctggagcgcgcgggcgccggccagggcagcatgtaccaccacttcaagggcaagcccgatctggcgctgaccgcgatccgccgcaccgccgaggaactgcgggctgccgcggagggcgcgctgagcggtccgggcacgccgtacgagcgcatcgaggcgtatctgcgccgcgagcgcgacgccctgcgcggctgtccgatcgggcggctgacgatggacccggacgtggtggcgagcgaggaactgcgcgcccccgtcgacgagacgatcgactggctgcgcgagcagctggccgggatcgtcgaagagggaaaggaacaagggcagttcgcgcagtcgctggacgccgaggagatcgccgcgaccatcctcgcgaccgtccagggcggctatgtcctggcacgcgccgccggctcaccggcagccttcgacacgggcgtgcgcggcctgctctccctgctgcgccccccgccatgaggagttgccccggcgcacctcgcgcccggcacgaccaccgaccgggacgcacccgtcggcccggacgaacacccctcacccaggaggcacccggtgcacgccatgcagtacgagctgacccttcccgccgactacgacatggacatcatccgcagccgggtgtcccgcctcggtcatgcgctcgaccactgggacggcctcggattcaaggcgtatctgatgcgtgagcgcggcgtggacggctcgccggtcaaccagtacgcgccgttctacctgtggaacacggtcgagggcatgaactccttcctctggggaggcgccttccaggggatcgtcgacgacttcgggcgaccgccggtgcagcagtggacagggctgtcgtacgaggaggggggcgccgccggctccccggccagggtcgcggtgcggcaccggcggcgggtgcccgagggggcgcggctgaccgggctgatgcaggacgcggtgcgggaggctcagcagctggccgcgctggacggcgtggtgggcgcggccgccgccgtggatccgcggcgctgggagctggtgcacttctcgctctgggagcatgacgcgccgaaggcggcgggtgaggtcttccaggtgctgcacctgtcggcgccgggccgggcgagcctgccgcgggggcgtcagtggtgagcacggtccgcaccgtgctcggggacgtgctccccgagcacctgggcgtctgcgacgcgcacgatcacctcttcttcggcagccctcaactcccgggacaggaactgcgggacgcgtccgccgcccgggcggaactggccgccttccgcgagcagggcggcgggagcgtggtgcagtggacgccgtacggcctgggccggcgcgccgcggacctgccgctgctgtcccgtgacacgggcgtgcacgtggtggccgcgaccggactgcaccaggccgtccactacgacgccgggacgctcgccgagctgcgcggccggctggccgacacgttcgtcgccgaactcacgaccggcatcggcccgtccggggtccgggccgggctgatcaaggtcgccggcggcttccacgccctcgacgcgcacgcccgctggacgatgaccgcggccgccgaggcccaccacgcgacgggcgcgcccatcgcggtgcacctggagcttggcacgggcgcgctcgacgtcctcgacctgctgtgcggtgagtcgggtgtgccgccgcaccgggtgatcctcggtcacctgaaccgctcccccgatttcacggtgcaccgccaggccgcggaggcgggcgccttcctcgcctttgacggcccgtcacgcgccaatcacgccaccgactggcgcatgcccgacgcgctacgggccctcgccgaggcgggcttcggccatcggctgctgctcggcggcgacacgacgaccgcggcggcgcgctcggtcaacggcggccctggactcccgtatctgctgcgccgactgcgcccgcggctcgaacaggccctggggaaggacctggtgggacggatcttcaccgagaatccggggcgggccttcggggtggaatggcgctagggcctgtcgcaggcaccggttcaggagccggccgagatgcggcgcccgctcggggcgccgtggagcccggccgggccgtgagccgtcaggtcccggccagggccgcgagcggatcgtccagtaccggctgccacgccaactccgcggcgcccacgaggctgttgtggtcgagggtgcaggggaggatcggtacgccgccgctctggccccacaggctgcggtcggcgacgacggcgcgcagccggtccgggtcggcgtcgagcagggtgcggtgcaggccgccgaggatgatgcggtccgggttgaggatgttgacgagtccggcgagtccgaggcccagccggtcgatcagcgcctgcgtcgccgtccgcacatacgggtcggcgtactgggtgcggatcaggtcgttggcctgctggagcagcgagacctcggggccggggtcgcggccggccgcggtgaggaaggccagcggatccgcctccacgtcgaggcagccgcggctgccgcagtggcaggggcggccgccctcggggttgaccgtcagatgcccgacttccagcgcgagtcccgaactgccggtgtgcagacgcccgtcgaggaccagggcgccgcccaccccacggtgtccggtggccacgcacagcaggtcacgggagccgcggccggcgccgtgccggtgctcggcgagggcggcgaggttgacgtcgttggcggcgaaggcggggcccgtgatgcccgccgcgcggacgcgctcggcgaagatctggcggacgggcgcgcccgccggccaggccaggtgcagcgggttgagcgcgaggccctccggctcggcgacggcggacggcacggcgagcccggccccgacacagcgccgtccggtctcctcgagcagctcggcgcccgcctcgaccaccgagccgagcaccttcgccgggtcggcgtcgacggtctcacagccgggcgcggtggcgacgatgcgcccgcccagaccgacgagcgcggcccggaatccgtcggcgtgcacctgggcggcgagcgccaccggcccgttctcggcgacctccagccggtgcgaggggcggccctgcgagccggcggcggcgcccgggtgcgcgtcgacacggatcagtcccagggcctccagctccgcggccaccgctccggcggtcgcccgggtgacccccagctcggcggtgagcacggcccgcgtcggcgcacgtcccgtgtgcaccagctccagcgccggcccgagcgcaccgcgtccccggtccagccgcgtccgtgtgttcccttcccccgccacccgggggcccgccttgccattcatgagggcgagtctcccatgatccgctccggtgagacccggcagccggctccgatgaggcccggcagccggctccggtgagggcccggcgtccgccgcgccgggggccccgcggtcgatgaccgccgcttcggtctcattcgccggacgggtcctggaagccgctcacccgcagcgtgatgttcagccggcccacgagccccaactcgggcggcgccgtgtccgcgtacaccctcggtaccccgtggtacgcgagccggctcgcgccgccgaacacgaacagatcgccgctgcgcagttccacgtccgtgtacggccgggtccgggtccgcgcgttgccgaagcggaagacgcaggtgtcgccgacgctgagcgagacgaccggcgcgccggacttctcgtcgctgtcgcggtgcatgcccatacgggcgtcggcgccgtagaagttgatcagagcgatgtcgtacgggaccggcggcaccgcctgcgggccgagggcgtcggacaccgcgtcgcggccgagctccgccagccagtccgggagcggcttcacgggggcgccgtcgccgtcgacgaccgtacgggcgtacccgtagggataccagtgccagccgaggcagacctgccgggaggtcatcgtgccgccgccgggggtgtggacggtgcgcaggccggccggtgggcgggcccagtcgcggcaggccgccaggaaccgccgctgccggcccgcgtccgcccagtccggcacatggaccgcgtccggtgcgacctgtgcgcggcttcgcgggaacagctcggcgtccatgcccccatcatcacgtaccgcctcctcgcccatcggcgcggaccggggccgatctgcggctcggttagcctggagccacgatgaacgacccgatgaccacgccctggggcgcgtacgcgctcgcccgcttccccgaggatccacgcgaccggctgcgtgcctgggacgcctccgacgcgtatctcctgcggcacctcgcggcgagcggcactccgctctcgggatcggtggtcgtgctcggcgaccggtggggtgcgctcaccacggcgctcgcggcgcaccggccgacgcagatcaccgactcgttcctcgcccgggaggcgacccgggagaatctcggccgggccggcgtcgacccgtcctcggtccggctgctgaccacgcgggacaccccgccggagcggatcgacgtgctgctcgtacgcgtcccgaagagtctggcgctcctggaggaccagctgcaccgtctcgcgccaggggtgcacgaggggacggtcgtcgtaggcgccgggatggtcaaggagatccacacctcgacgctgaagctgttcgagcggatcctcggcccgacccgtacctcgctcgccgagcagaaggcccggctgatcttctgcaccccggacccggggctcgtacgggacccgaatccatggccgtaccgctatcggctccccgacggcgtcggcccgttgtcggggcggcccgtgaccaaccacgccggcgtcttctgcgccgaccggctcgacatcggcacccggttcttcctgcggcacctcccgcgcgtgagcggggccgagcgtgtggtggacctgggctgcggcaacggagtcgtcggtacggcggtcgcgctgaccgagcccgaggccgaggtgctgttcgtggacgagtcgtaccaggcggtggcctcggcacgggagacgttccgggcgaacgcggacgggaccgccgagttcctggtgggcgacggtctttccggggtacccgccgcgagcgtcgacgtcgtcctcaacaacccgccgttccactcccaccaggcgaccacggacgccaccgcctggcgcatgttcacgggggcgaagcgcgcgctgcggccgggcggcgagctgtgggtgatcggcaaccgccacctcggctaccacctgaagctgcgccgcctgttcggcaacagtgaactggtcgcgagcgacgcgaagttcgtggtgctccgggccgtcaagaagtaggcgtcccgctacccgagccggtcgtccggtgctgcgggccgccggcggcccgcagcaccgcgatgagctccgccgccgcggccgccatcgcctcccgccccacactgaggtacttgcgtgagtcgaccgcgtcgggatgtgcggcgaggaactccctgatcgctctggtcatcgcgaggttcagcgcggtcccgatgttgaccttggctatgccgcccgtgacggccgccgccagttcgtcgtccggcaggccggaggagccgtgcaggacgagcggtacgtccagctgcgcggcgagccgcctgagcagaccgtggtcgagcgcggccgtgcgcgaggtcatcgcgtgcgagctgccgatcgccacggccagtgcgtccactccggagtcggccacgaaggcgcgcgcctcggccggatcggtgcgggctccggccgcgtgcgcgtccagcggcggctcgccgttcttgccgccgacctgtcccaactcggcctcgatccagagccctcgggcatgtgcccagtcggcggcggcgcgggtcgccgcgaggttctcggcgtacggcagccgggccgcgtcgtacatcacggagccgaatccggcgccgggcgcctggcgcagcaggtcgtcgctctggacgtggtcgagatggagtgcgaccgccaccgacgcccgttcggcggccgcggccgcggcccgggccagcgggagcagacggccgtagcggaacttgacggcgttctcgctgatctggaggacgaccggcgcgccgacggactccgcgcccgcgatgacggcctcgacgtgctccagggtgatgatgttgaacgcggcgacggcggtgtggtccgcggtggctccggcgatgaggtcaccggttgctgccagtggcacaactcctccttctgcggcggcggtcgggccggttcagcgggcggcgggggcgagtatcaccgagcgggtcagatggcgcggccggtcggggtcgagtccgcgggcggcggccacggcgaccgcgagccgctgtgcgcggacgagttcggcgagcgggtcgagaccgccggccacccacagtccgccggtttcccggacctgttcggccagtccttcgggtgcctcgccgagcatccaggtggcggtcccccgggtggtgatgctgatggggccgtgccggtactccatcgccggataggcctccgtccacgccagtgcggcctcgcgcatcttgagcccggcctcgttcgcgagcccgacggtccagccgcgcccgaggaaggtgaactgcgtgcactcgacgagcccttcgggcagcggagtgtccagggcggtgcgggcgtcggcgaccacggcgtcggtgtgcaggccgaggtgggcgcggagcagggtgagggcggtggtcgcgaaccgggtctgcacgaccgaccgctcgtccgcgtagtcgagcacgacgacctcgtccgccgactccatcacgggggtgcgcgggtccgcggtgacggccgtcgtgcgggtacggccccggagttcggcgaggagcgcgaggacctcggtggtggtgccggagcgggtgagcgcgacgacacggtcgtacgcgcgtccgggcgggaattcggaggcggcgaaggcgtccgtctccccctgtccggcctgttcccgcagcgcggcgacggcctgcgccatgaagaacgaggttccgcaccccacgacggctacccgctcccccgtcgcgggcagtgctcccgcgtactcggccgcctccgtggcggcgcgggtccagcaggcgggttggctgttcagctcgttctcgacatggctcatgccgtaacccctccccagcgatgcactttcatgcaagatatagcggcctttcgagcacaatcaagcatgcggagggaagtaaggggtgcgctaaggtcgccggagatcgaggaacggagagtggggatgtcgcgcgacgcccgctggaagacactgctggaactgctcgtcgagcggggccggctggatgtcgaggaggcggcggcccagctggaggtgtcggcggcgacgatccggcgcgacttcgaccagctcgccgagcagcagatgctggtgcgcacgcgcggcggcgcggtcgtgcacggcgtctcgtacgaactgccgctgcgctacaagacggcccgccacgcctccgagaagcagcgcatcgcgaaggcggtggccgagctgatcgcccccggcgaggcagtggggctgaccggaggcaccaccaccaccgaagtggcgcgggcgctggccgtgcgcggcgacctcgcgtccggctcgcccgcgctgaccgtggtcaccaacgccctcaacatcgccaacgagctggccgtacgacctcagttcaagatcgtggtgaccggcggggtcgcgcgcccgcagtcgtacgagctggtcgggccgctcgcggacggcgtgctcggccagatcaccctcgacgtcgccgtgctcggcgtggtcgccttcgacgccgcgcacggcgcggccgcgcacgacgaggcggaggccgcgatcaaccggctgctgtgcgagcgcgccgagcgcgtggtggtcgccgcggactccagcaagctgggccggcgtgcgttcgcccggatctgcgcgacggaggcggtggacacgctggtcacggacgcgccggtgagcgaggacacggtgcgccgcttcgcggaggcgggcgtggaggtcgtcgcggtctgaggggtctcgccgagtgccgcgtcgggcacgagggccgacgccgacgtgtccggcggaaaggccgcgctcaccgtccggcggaaaggccccctcacctcaccaccggccggtccgccgtggacgctcgcgcggccgccctgggatccggcatctcctccggcggcgactcctgaaatccggccgggacccgggcggaccgcccacggccacccgtaccgaccgtgacgttcgccgcaaacgcggccgggctgttgtggccggcgaccggaacctgatccagtggccccagcgtcgagatccgggggaacaccgcatgacaaccggccatttcacatccgtcgaggacgtctccgcacgcctcgcggagaccggctatctggcgtcccccgcggtcgccaccaccgtcttcctcgccgaccgtctgggcaagcccctgctggtggagggccccgcgggagtgggcaagacggagctggcgaaggcggtggccgaggtcgcgggcgcctcgctgatccggctccagtgctacgagggcgtcgacgagtcgcgcgcgctgtacgagtggaaccacgccaaacagctgctgcgcatcagcgcgggccgtgacgagacgtgggacgaggcgcgcacggacatcttcggcgaggagttcctgctcccgcgcccgctgctcaccgccatccgcggcgacgagccgaaggtgctgctgatcgacgagaccgacaaggccgacgtcgaggtggagggcctgttgctggaggtgctgagcgacttccaggtcaccgtccccgagctgggcacgatcaccgcgacgcgccgcccgttcgtggtgctcacctcgaacgcgagccgcgagctgtccgaggcgctgcgccggcggtgcctgttcctccacatcggcttccccgacgaggagttggagtgccgcatcgtacggctgaaggtgccgggcctcgacgcggcactggccgagtcggtggtacgggtggtcggtgcgctgcgcgagatggatctgcgcaaggtcccgtccgtcgccgagaccatcgactgggcgcgcacgctcctcgcgctcggcgccgacaccctcgacgagaccgtcgtacgcgacagcctcggcgtactcctcaagcaccaggaagacatcctcaaggcgtccgccaagctcgacctggacgccgtgtgaaggcgccggccgcgtccggtgtgcccgaacggctgaccgcgctcgtccaggcgctgcgctcgcacggcatccggatcgggaccggcgagaccgtggacgccgcacgggccctggaggcgctgggcctggccgaccgcgagtatctgagggaggggctcgcctccgcgctgttgcacggcaccgggcagcgggccgtgttcgacccggtcttcgatctctactttccgcgcggtgtcggagtaccggagcccggcagcggtccggccccggaccgggacgagctgcgggaccggatcgccgccgccctcgccgcgggcgatgaggcgctcctcggccagttggcggccgaggcggtgaacggcttcggggggtacgggagttcaccggggtcggacggctggtcgtcgtaccagacgctcgaccggctgcgtccacagaccctgctcgcccgcgtccgcgcgagtgtcctggcacaggccacggacagcgggttcgccgaccggttgctcgacgacgagatccgccggcgtatcgaggagttccgccggcaggtgcgcaccgaggcacggcgcagggtcgccgagcggcgcggggcggacgagatcgcccgccggggtgtcgccccgaccgccgaccgggtcgacttcctcttcgccggacgcgcccaactcgccgaactgcggcggacggtgcagcccctggcgcgcaaactggccacccggctggccgcgcgccgccgccgtgcctcccgcggcaccatcgacctgcgccggaccctgcgcggctcgctgtcgacgggcggcgtgcccatgcgcccggtcctgcgccgacgccgtccggtccgtcccgaactggtgctgctgtgcgacgtgtccggctccgtggccggcttctcggacttcaccatgctgctcgtgcaggcgctgcacgaccagttcagcaaggtgcgggtgttcgccttcgtcaaccggatcgacgaggtgaccggcctggtcgtccgcggtgcggccgacccggaggggctcggtgcccgcatcatggcgcaggccgccctgacgggctggcacgacagcagcgactacggcgtctcgctgggcgagttcgcggagcggtacgccgacgcggtcgggccccgggcgtcggtgttcgtcctcggtgacgcccggacgaacaggagcgacccgaaccttcccgccctgcgccgcgtcgccgaacgggcccggcgggtctactggttgaaccccgagccgcacacccagtggggcacgggcgactccgcggccctcgcctacgccgaggtcgtcgagatgcacgaatgccgcaacgcccggcagctcggcgagctcgtcgcgcgtctgcttccggtgtaggtccctccccgaaccggactggctcgaccgggttcacgcgcgcatcgggtgaggcatatacggggggacggacggaactcgcgccccacggctgccgaaggacccaccgcatgcgcagatcggctcgtacggctccggcggcactcacgcctctggccgatcacgtcgaccccgcctggctgccgtccgaggcgttccgcgcgctcggctcccggcgcaccgtcgtgtgcgggaccggggcgctcgtcgacaccgtgcacggtgaagtggcgtgggcgtgcggggcgttcggcggttcggtggtgcgtgccgaggagccggcggacgaccggccatgcgacctgctgctgcacctcggcgaacgcctggacgcacccgagccgctcggcgacgaggggttcacgctggtgcggcggcggggccggacgacggtgaccgccgcggggcagcgcgggctgctctacgggctgttccatgtcgtacggctgggcgaggccgcgttcggtgcctcgcgagcccgcgaggcgcaccgtcccgcgctggcgtcgcgcatgctcgaccactgggacaacgtggcggtccacccggtgatgggacaggtggagcgcggctacgcgggcggctcactgttctggcgggacggccgggcgcgcggcgacctggagcgagtgcggacgtacggacggctgctcgcggcctgcgggatcaacgcggtcgccgtgaacaacgtgaacgtgcacgcgacggaggcgcacctgctgaccgaccggatcggcgaagtggccgagatcgcgggcgcgttgcgcccctacgggatcaggacgcagctgtcggtcaccttcgcggcacccctggtcctcggcggcctggcgacggccgacccgctggacgaggcggtgcgcgcgtggtgggccgaggcgaccggccgggtgtacgcggcgattcccgacttcggcgggtacgtggtgaaggcggactcggaagggcagccggggccgttcgcctacggccgcagtcacgcggacggcgcgaacctcctcgccgacgcgctcgccccgtacggcggcaccgtgcactggcgggccttcgtctacgaccaccggcaggactggcgggaccggtcgacggaccgggcgcgcgccgcgtacgaccacttcgtgccgctcgacggccgcttccgggacaacgcggtcctccaggtgaagcacgggccgatggacttccaggtgcgtgagcccgtctccccggtcatcggcgccatgccgcgcacccggctcgcggtggaggtgcaggccacccaggagtacaccggccagcaacggcatgtgtgcgcgctcgcgccgatgtggagccaggtgctgcggtggcgccccgagggggcgacggggacgagtgtcggggagctggcgcgcggcggactggtggcggtgtcgaacgccggcgacgacccgtactggaccgggcaccccctcgcccaggccaatctctacacggtggggcggctgggctggcagccggacgccgacccgttcggcctgctggacgagtggatcgacctgaccttcacgcccgcgcgcaccgaggctccggagcgactggtcgccggactgcgcgcggtgctgtaccgctcctggcgtacgtacgagaagtacaccgccccgctcggcgtgggcttcatggtgcagccgggacaccactacgggccgagcgtggacggctacgagtacagcccgtggggcacgtaccacttcgccgaccgggacggcgtcggggtcgaccgcacgcgcgccaccggtaccgggtacgcggggcagtacgccaagccgtgggcggaggtgtacgagtcgccggacacctgccccgacgaactgctgctgttcttccaccatgtgccgtacgggcatgtgctgcacagtggcaggacggtgatccagcacatctacgacacgcacttcgagggcgtggccgaggtcgaggaggcccggcaggtgtgggcctcgctcgtggacctggtggagcctgcgcggcacacgcgggtggcggagcggtacgaggagcagctccgcggcgcccgcgagtggcgcgatcacatcaacagctacttcttccggaagtccggggtgccggacgcgcacggtcgccggatccactgaggccgtaccgaggccccgctgaagccccgttgaggccccgttgaggccctaccgaagccgtagtaccgccacgccgagcgggtcgagggtgagcggctcggaccgctcggaccgcttgccggtcagcaggtcggtggcggtggcgtgggcggtcaggcgggccggttcgggcgcgtggttgaggaggaacagcaggcgggttccgtcgggggcgacacgcgtggcggtctccacggccgggtggtcggcgtacgggccgatcaggtcgtggcgggcgaggacgcggcgtaccacccagtcgacgccgggctgtgccagggccgtggcgacgtaccagccctcgcccccgcgttcgccgaagcggtgacgggtgacggccggggtgcccgcgtagaagtcggcctgatacgtgccaaccggctcggcgcctcgcgggaggacgatctcgaagaccagccgtgcgtccgtgtgcacgacgtctttgtcgtcccccagggtcaccgggtgggcggtgtccgccgggcgggcgtcccactcgtcgacgcggatgcccatgagcggcgccagcgggccggggacgtcggccaggaaggcccggtcgtgggtgtcgacgcggcccgagaggaaggtggtgagcaccgtgccgccgcgtgcggccacggcttcgaggcggccggcgagatcacccttgaccatgtgcagggcgggcgcgagcaccacgtcgtacgcgcggaggccggcggtcaccggtacgacgtcgatgtcggcgccggcctcgcgggcggcccggtagtaggcgtgcacctgatcctggtaccggacaagccgggaggggccgtcggagatctccagggcccaccagctgtcccagtcgaagaggagggcggtacgggcgggggtgcgggcgccgagcggggtgtcgccgaggagctcaaactcccttcccaggtggctcacttcacggaacacccgggtgtcgtcgcggcccgcgtgcccgatgaccgcgccgaagtacttctcgcaggcgccacgcgaggcgcgcagctggaagtagaggacggcgtcggcgccgtgggcgacggcctgccagctcgcgaggcgcagttcgccggggcgccgcagcgggttgacgtcgcggcaggccgtggtggacggggcctgctccatcagccagaagggggcgccgtccttgaggccgcgcatcaggtcgtgggcgagcgccggccaggtcggcggggcgtccaggggcgggtagttgtcccaggaggcgaagtccaggtggggcgcccagcggtggtagtcgagcgggcggtacatgcccatgaagttggtggtgacgggcgtctcgggactgtgctcgcggatcgcctccttctcggcgaggaagcagccgagcagcgcgtccgtggtgaagcgcaggtagtccagggtgatgccctggaaggcggtgtggtcggggccgcgccagtgctcggtgagcgcgctgggcggctcgatctggtcccagtcggtgtagcggtgcgaccagtaggccgtgtaccaggcgtcgttgagggcgtcgaggccgccgtggtgttcgcgcagccagcggcggaaggcctcggcgcacaggtcgcagtagcaggcgccgccgtactcgttgccgatgtgccaggcgagcagcgccggatggcccgcgtagcgctcggcgacccggccggccagggcggtggccgcgctcttgtaggcgggtgagctggggcagaagttgtggcgctggccgtagcggtggcggcggccctcgaagtcggtgcggttgacgtcggggtgggcgcgggccagccacggcggaagggcggcggtgccggtggccaggcagacgcggcggccctcggcggcggcgcgctccaggatgccgtcgaggacgccgaagtcgtaggcgtcctcggcgggttgagtgagggaccaggcgaacaccccgacggtgagggtgtcgatccgggcctgggtgaacaggcggtggtcgtcgtcccggacggcctcgggccactgctccgggttgtagtcgccgccgtaggggatcttgccgatgccgggcgcggtcatgcggtgaagtcctcctcggtttcggtgatcaccggacggcaggcgtgcaacagggacagcagcaggaggggggcgagcagagcgggcagggcctcggtggcgagcagggtgaggccggtggtgaggacgatcagggaggcggcgccgagggtggccctgacgtgccggagcaggaagtacgcggcgaggcgacaggtgtccgcggtgcggaaggtgaacagggaggtgaggacgagggcgtgggcgccccagagcaagcagccgaggccgatgacggccagcagggcggcccaccagccgggcagcccgccgacggcgaaatgggtcaggcagaaggcgatgacggtgagccaggcgagcagcggggtccagatcttcagggcgggccgggcgttcaggcgccagccgcgccagtagtcgcgggccgggtgcaggtcggtgaggtcgcggccgcggtggtgcagcgcgtacacggcggccgcgagggcggggcccagcggcagcagacaggccgcggcgagcggcagaccggacgggtcgggcccgaggacgagcagggcgccgaggcccggcgacgcggcggtgagcagcatcacctccacggtgagcagggtgtggaccagggcggcggcacgggagagcgggccgtcgccgaaggaccgggtgcgggggcttcgggtttcgccggcccggccttcgtccacgacgctcatcgcggctccaccggggagcccagcaggcgccgctcgtcccaccacggcggtgtctcgtcctcgacggggctcagctccaccagggtgacctcgtggcgggcgagggtgaggccgaggtcggcgcggaagtcctcgacggggaggcgcagatggctgcgggcgggttcggcggcctcgtgcagcagatcgatctggtggggccggggcgagcgcgggccgcccatgtgccgccacgcggtccacgcgttgccgtgctcctcgtccacggtggagcgccggacgaaggcggcgccgcgcggcctcctgcccacgggcacggacagccgcagggtgtgccggtccgggcccggtgtgcggccggtctcgtcgacgggcgcccaggccagtacggtgacccgaccgtcggggtggcgggtgacgagatggtcgtcgccgcgctccagcagttcctcccccatccgggccatgaacgcgtacaggtggtacgtgggcttcttgacctggcggtgggtgagcagcccgaaaccgccgtggaacagcgcggtgggcacaccggactcctcgaacatgtcactgaacgtccagtacgagaacgagtccgcgtggtcgccgcccgccgcgagtacgggcgccaggtaggcggcgtggaacgcggtgtcgtggatcggattgtccggacggtaggaggagttgaactcggtgatgtggaccgggagttcggtgtatctcgtgcccttgagctgctcgcgcggccgggcgaactggtcgagcagccgccgcgccggggcgagggtctggtacgcgccgaagggcaccggccgggccggtcccgaggtgtacgcgtgccgcgacacgaagtcgaccgggacctcgcggcgctccgcgaactcggcaaaccggagcagccactcgtcggcgccgggcgagatcgccgggccgcccacctggagggaggcgtccacgtccttcaccgtgcgcgcggtcacctcgtacaggcggtggtactcggcctcgtcggccccttgccagaagtcggtgaggttcggctcgttccacacctcgatcggccaggtgcgcacctcctcgatgccgtagcggtcgacgaggtgcgtgagcgtcgcccgcacgagccgcgcccactcgtcgtacgagcggggcggggtgacattgccgcgccaccagaagaccgtctggtcgccgctcgccaactccgtgggcatgaagccgagttcgaggaaggggcggacatgcagacccaggtaggcgtcgacgacctgatcgacgtaggtgaacgagtggtgcacacgccgcgccccctcgtacgcgtacggccggtacacgcccatgccgtcggacagcagcccgtgcccccggatgtaccggaagccgatctcgcgctggagcagcgcgagggagtcctggtagtcgcggcgcagggccagttcgatgcggcccgtgccgacgcaggcgcgccaggcgtcggagagccgtccggtcgcctcggcggggacgctgatcacccgtgctccttcttgaagcgctcgtacgccgtgttgtgcaggtcgatgtaccgctgcatgttcttggccttgagttcggcgaggtaggcgtcccattcgctcatcgggcgcttgccgagggcgaacttcagtgtgttctgcgtgacgtggtccttgagcggcgtgtcccaaagcgtcgcctgctcctgctcgtcggccttcagcgggtgggccgggtcgaccgggaggagcttgcgtcccgccatggcgtcctggaacgccttctcgtccggggagaacgaggaggacaccagggcccaggagccgccgtaggcgaactcgccgttggtgaacccgtagtccttctgcaggtccttcggcgcggaggggtcggagcccatgtagctgatgccgtccgcgaccttgtagcggcccgctcccgagctggtgtaggtgacgccctcgacgccgtacttggcgaactcctgtccgccgtccgagtaccacagccagtccacgaactgcatcatggcgacgaagctgtcgccctcggcggccctgccggcgaccatcaggccgttctccaggcggctgcccacgatcacctcgccggtcgggccgatcggcaccgggatcatctcgatggtcgcgcccttgacctgtttacccaggttgtagcggtagttctgcaccagttcctgcgggttggcgctgatgacgaaggacttcccggacagcagcttccgcaccgcgtcgtcgtcggactgggtgaagctctcggggtccatcagcttctcggcgacgagcttgcgcaggtactcgagcatctgccggtactcgtccgtcgccccggtgaagacgtacttccgtgccttggtgtcccaggcggtgttggcgtagctccagccggccttcgtgccgaacgccggtcccaggtagttgaggagcgcgccgcccggtgtgggctggccccagcggtcggagaacggatagacgtccgggtacgcggccttgagcgccttcagcacgtcgtagacctgatcccaggtggtcggcaggtcgaggccgtgcttcttcaggacgtccgtacggaaggagagcgagtagccggacttgaccttctcgtgcaggccgggcaggacgtagtagttgccgtcggcctgccggatgctgtccaggtcgccctcgagtccccacttctcgaccttcgcccggaagttcggcatgagcctgacgtactcgctgaccggcaggatggccccggaggacacgaacgcggtctcctggcccgggtacgtcttggggatcagtaacggcgcgtcgcccgcgccgatgagcaggcttcgcttcttgtcgtagtcgctggcggggaccgaggtcggcttgagggtgacgccggttcgctcggtgacctccttccagaacagccagtcgcgcttcatcgggtaggtcggcatgtcgttgtgcaggatcgtgaaggtgagcgccttggtggccttgaactggtcccccgccccgtagttcttcatcgcgccggcccgcttcttggagaggtccttcgtgtccgcctccccgtcgccgctgccgcagcccgtcagggcggcgaggcccgcgaacccggccacggcgagcaggcctctgcgggacagctgtccggtgttcttcacggatgactcccttgtttccgtagttcggagcgcggtcagcccttgacggcgccgagcgtcacgccggagacgaagtagcgctggacgaacgggtacacgaggaggatcggcagcgcggtgagcacgatcgtcaccgactggatgttcgccgcgacctgggtgagctgttccaggtccgccccggcgttctcgccgccggtcgcgcccgcgatgaggttgcgcagatagaccgtgaccggcatctcctcggccctgtccaggtacaggaaggccccgaaccaggagttccagaacgacaccgagtagaagagcaccatcgttgcgatgaccgccttggacagcggcagcacgatccgcagcaggatgccgtaggtgctgaggccgtcgatctgcgcggcctcctccagctcggtcggcaggctctcgaagaacgccttcatcaccaggaggttgaagacgctgatcgcgttcgggatcaccatcgcccacagcgtgttcttcatgccgaggccggtgatcagtacgtagttcgggatcaggccgccggagaagaacatggtgaacacggcgacgccgacgagcgcgccgcggcccttgaggtgcggtttggccagcacgtaggcgtagcaggtggtgagcaccatggcgatggcggtggcgaccacggtgtacaggaccgtgttgccgtagttccgccagaacatcccgtccttgaggacgatcttgtaggtggtgaggttgaagccctcggggagcaggttcacctggccggcccggatgcggtcctcggcgctgaacgagcgggcgacgatgttgacgaacgggtagagcgtgacggccacgacgccggtcaggatcagcccgttgaccgcctggaagacgcggtggccgcgggacggccggccggccgagagacgcgggcgggcagggcggcgcgggcgcccgtcggagagggtcaccacaggctggtccccactgtgcggcgcgagagctggttggcggagaagatcaggaccaggccgatgaccgcttcgaacaggccgatggccgcggcgtagctgaagctgttggactcgacgccggtgcggtagaggtacgtggagatcacgtcggcggtgggatacgtcagcgggttgtagaggagcaggaccttctcgaagccgacggccatgaacgtgccgatgttgaggatcagcagcgtgatcatggtggggcggatgccgggcagggcgacgtgccagatctgcttccagcggcccgctccgtcgatgcgcgcggcctcgtacaggtcctcgtcgatggtggtgagggcggcgaggtagaggatggtgccccagcccgcggtctgccagatctccgagccgacgtagaccgcgcggaaccagtcgggctcctgaaggaacctgacgggcgcctggccgaacgccttcagggcatggttgaccgggccgtcggtggcgagcatctgcatggtgacgcccgcgacgatcacgatggacaggaagtgcggaaggtacgacaccgactgcacgaaacgtttcagcgcacgggtgcggacctcgttgagcaacagcgccagcacgatcggcaccgggaagcagaacaccagggtcagcgcgcccagccacatcgtgttggtgaacacctgccagaacgtcggatcggtcaggaacatgcgcacatagcgcaggccgacccaccgctcgcccagcatggagccgcccggttcgaagcgacggaaggcgatggcgttgccgatcatcggcagatagcggaacaccagcaggaacagcagcggcagcacgaccagcgaatacagctgccagtcacggcgcagcgcctgccgccaggtgcggcggggtgcgggccgccggcgcggccggggtgcagtgtgctcggacggcgatggattccgcgcgccgggcgtggggtccacagcggtggggctggtcatgctcgggcctcccgtggcgagagcagggaaaggcagtgcacgtccgacgaggcccgtccgtatgaacgcggccgataagttccataaaaattccggtaacgcagcggcaacctaggggcgcctgatgtcgctgtcaatggatgccgcacgatgtggaattggggcagcatgggcgtttgaacgctccaacacctaggtacgacacctgagttcacctgtcagcgtctaccgataatttccggccttccaccgtaactatcggacggcccgggccgtccccgaccgcttgcgaggtgccgtgcccgcattcgatctaccaccggccgaactggagaaccaccgccccgccccccacgagcccgccgatttcgacgccttctggcaggccaccctgaaggagtccgggcaggccgagccggtcctgtccgtgcggccgttcgacagcggcctgcggctggtcgagacctgggacgtgaccttccgcggcttcgccggcgacccggtgcgcgcctggtacacccggcccgccgaagccccgcgaccgctgccggccgtcgtcgagtacgcggggtacggacgcgggcgcggactcccgcacgagcggctcacctgggcggccgccgggtacgcccatctcctcatggacaaccggggccagggcgaccagtacgggtgcggcggcgacacccccgacccgcacgccacggcaccgagcggcccgggtccggccgtacgcggactgctggacccgcgcgactaccactaccggcgcctgatcaccgacgcggtgcgcgccgtcgccgccctgcgcgcgctgccgggggtggacggctcacgggtggcggcggtcggcaacagccagggcgggggactcgctctcgccgtcgccgggctcgtccccgacctcgcggccgtactggtcagcgcgcccttcctgtgcggcatccggcgcgccctcgaactcaccgacgccgccccgtacggtgagatcaccgcctatctcgccgtgcaccgcggcgccgaggcggctgcgtatcgcaccctctcctacgtcgagggcgtctccttcgcccggcgcgcgaccgcccccgcgcacttcgggatcggtctgcgcgacacggtctgcccgccgagcggcgcctacgccgcgtacaaccgctacgccgaactcaccggccacgaccccttgaaggagatccacccctacccgttcaaccagcacgaaggcggcgacgccgtccatgtgcgccgccaactcacttggctcgacggcatcctgggcggctgacgaggggcggccgactgtgcgcggcacccgccgccgcgccgcggtcacccgatccgcggcaggccctcgacgcgttcgtccaggagggcggagtagttggcgcacatcttgtcgacgtacgtgtcgaggttgaactggcgctccacgtgtctgcgcccctctcgccccagccgcttcgacaaggccgggtcgaggagcagtcggcgtacccggtcactgagctgttccaggtcgcccggggtcaccacgtacccggtccggtcgtgcaggacggcctccggcagaccgccggtcgcggtgaccacgacgggacgcccggcggacatcgcctccagcggcgccagccccaggggctcgggatagtccgaggggtagacgacgacgtgggcacgcgcgtagagccgtggcatcagttccttgggggtcgggaccaggtccacgtgggggcgcagtcccaggccgtcgatcaaccggttgagacggtcgaggaacccctgctgctcctcgtgccagtcgacgacctcctgaggacttgtcagcacaagccgtacgctcaggccggtccgcctgagtgtgtcgagcatgcggacagccagctcggcgcctttgttggggatgagacgagcgggcaggagcacggtgtgggggccgtcgctccgcgggggcggcagactccggaacctgtcggtggcgatccccagataggtgcgccgggcccggatgccgagatgagtgcggcaggcgaacgcgaggtagtcggacaccacgtagtggccgtcccaggaacggcagaactgcgctgtccacggatcctcgggccagacgctgtggtacgtgtgcaacaaggtcgtaccgctctgttcccgaagccggttgagggcgagggcggggaccggcgagaagtgatgcaggttgtgcccgtgcacgattcggatgtcgcgcgcgtccacgacccgggcgagccactcgtggagttcggccgcccgacgctgttcgaccggcgtcagccaccttcccgtgcggctgttctcacccagggcggcatggtggtactccgcgagccgcagcagcggatgtgtgaggatctcgacccggtcgacgggctgcggccgggcctcaccggtcagcagggtcacctggtatccccggcgggtcagccggccggcgtagtcggcgagatgtgactcgacacccccgaccgtagggggaaaggcccagtgcacgagggcgatggaacgccgcgattccgatggcctgccgcgtaccacgtgtctccctctcgtcggggaccgctgtgcgttaggtcgtgcagggggcgggggcggcgatgtgccagtgcttgccgtcgatgccgagcacctcggtgccgccgtgggtgtcgacgcggacgtccaccgtgtccgcaccgagcctcaacccccgaacagagtagggggaattcaggcccatgagcgagggcgcgatcggccgtaccgtcagccggcggcgcggaacgtcggcttcgagaccgagcatcgcggagcagaggagcgtggccgaggccgctgcccacgcctgggggcggcaggacggcgggaacggggccggccggccgaagcggggtgaggggtaggcggcgtagagctcgggcagttggtggtcgaagtgcgcggccgcgtcgagcatgccgtcgatcagcgccgcggcctcggcggcgaaccccgcggtggcgagcccgtggaccgcgatggccgagtcgtgcgcccagaccgaacccccgtgatagctgaagggattgaaccccggcagccgagcggaacgggtgcggattccccagggcgtccgcagttcctccgagacgagggcctcggccacctgccggcgttcctcgtcgtcgaggaggatcccggagttcagcagatgccccatgttggaggtcagtccgctgacggggtgcccttcggcgtcgacggcgatggccggatagcgccggcccttgggctcggtgatccagaaggaccggtggaaggcggcgcgcagtcggcaggcgcgctcctgccaccgctcggcctcaccgcccccgtccccgagggcggtgaggatgtcgctgtacgccatcgccgcctggtaagcgtagccctgcacctcgcacagggcgatgggcggctcgatgtgccgtccctcggcgtcgcggaccgcgtcgggagagtccttccagccctggtggagcaggccgttggccctgcccttgccgtagcggatcaggtggtcgccgcccatggcgccctccacccatttcatggcggcccgggcgtggggcagcagcagcttcagttctttctcgggaagaccccatttccaggcttcgtgcagcagcacgacgaagagcggtgtcgcgtccacggagccgtagtagcgggccggcaggaccatgccgtccccgtgccgtgtctcggccggacgcagttcgtgcaggatgcgtccgggggcctcctcggtgaacgagtcgtgccgctccccctggcgacgggccagggtccacagcgtgccgcgggcgagatccgtgccgagcggaagcatcatccgggccgcccagatgctgtcgcggccgaacagacccaggaaccagggacatccggcagccacgaactgatcctcacgctccccggcggcgctgctccgctcggcgaggcgcaacgcctccagatcggccagtcccctcttcagcaacgccgccatgcgctcgtgcccggtcacctccggggtctgccagggcacgccgagccgaggtggtacgggatggcccgccacggtggtggtcttgccctggagcaacaggcgtacggaccactcctcgtccggctgaaggcacagctgccagcggaactccgcacggccggggtgctcccggtcgagcaggagctccggcttgggcaggccgcccgccggtgccgtccggccgtccgccgacgtggtgagggcctcggcgcggagcaggacccggctcttgtcccgcgggcacagccagcgcacgcctcgggcgacgccctccacctgctcgcagccgacgtcgtcgaccggggctcccgccttgaccgtggcgacgtcggcgagatcggtcgcggccaccacggagagggtgaaccgcgcctcctgagagttgacgttgtgcagccggatgacgtcgcccgattccccgcttcccggccgccgcaccgcacgttcccgggtgaccagcagccagggggccgacgtcggatcgccgggctgtcggcacatcgcccggaacacggcctcgcggggaccctgctggccgtggtcgaccggctccggttcctgcccgttgacgagcactctcagcgtgtggagcagccgccggtcctggtcgtagaagccgtcgactccggtgccccgcaactgtccgtcggtggccgacagcgcgaacgacggggcggccaggcagatcaccctggtgtgcagaaacggctggaggccgacctcgggggaggcggagtcgatcactgaagtacctttccgaagcgctgcgtggccactgcgcctgtgccggctcggcctgtcgagcatgcgtcgcatcgccgcacgtaacaagggcggtccccggaggaattcagccccggcacgcgcttgatggggagcaaccataacggctcactgccgcctcagccatcgtccgaggccggtcgtcgccggagtcgaggagttctgcagcaacggcgccaaaaggcgctcttcacctcataattgttgctctcatcgggggacggtgttggacggggggatcccatgcgccgtagtaaccgggtgcggcgacgcctggaccaggtactggtgttcacgggagcggcggtcgccgcgggggcgggaacaggggtcaagttcgtcgacggcggcgtccaagccctgctgatctgtctgctggccggcgggaccggcatcggcgcgtacgccgcgaactccctgcgcgcccgcgccggcgggcccccgccccatgtcctgatcagtcacccggacggcgacgaaccctgggcactctggctggcgtggcggctgcggcgcatcgggtatctgacctccacccggtcctgggcggccacggagcgtaccgtgccgcccccgccggaggtggccccggaccacgaactgatcatcctctcccgggcgttggacgacgcgggtcccgccacggaggagacccgtccgtcccgcacgcggggcaggaccgtcctggccctggcgaccacccaccgcgatcccgcgctgaccaggtgggcggggtacgaggtgctcagcctggcgggccgcaccgccgccgaggcagccgccaccgtcgacgcccggctgcaccacgccggtgcgggcccccggcccgactacaccgccccccacgtggccggcgaggccgaaccacgctacccgggcgaaggcgccctggtcaccaatctccagccgcgcggcgtctcgcacttcacggcccggcgtacggaactcgccctgctgcgggaggtcctgggcagggtgaacgtctccggcgacggacggatctgcgcgatccacggcctgagcggcatcggcaagaccagactcgcactggagtacgcccgccggtacgaggatctgttcgacgtcatctggatggtcgaggccagccatcccccgaccgcgcgggcgagcctcatcgccctggcccgcgcgctccaggaacggcgggagcggcagccgggtgcggtggcggcccaggaggaacgcgacccggagcagacgctgcgccgcctgctcctcaacgagctgcccaggaccaagtcactgctgatctacgacggggccgaggacgattcggccatccgcgagttactgcccgacgccaggaacggcggccaggtcctgatcacctcggtcagccccgcctggcagcggatcgccccgcatcgcatcgccctcgaggagttctccgccgaggaagcggtggccttcctgagggacgcgagcggtgtcgacgacgtgaccggcctggggcgcatcgtcgaacgtctggggcggttacccctcccgctcgaacacgccgccgcctatctgcgccagtcgcccgacatcgactcctatctgcgcgcgctggagctgccctccagcctgaccccgcccgcccgtgccgatgtgagcccgagcggcgccgaggcgtggatcctctccttcaaccaggtcgaagcgaaggacgaggtcgccggtctgctcctgcgtctgtgcgcgttcctggccccgcaaggcatccccagctacttcttcgacaacgcggcggaccgcaccgacctgctcccggcggcgctctgcgagagcgtgacggagccggcgcgttacctgcggatcacgggtaccgcgaagagctactccctgctgacgggtgagggccagctggtcatgcacaccagggtgcaggccgtcatccgcgaggcgatgacggcccacgagcgctcggtccacgcggccgacgcggcccgcctggtcaacgggtggttcccggaggatccggaccgtgtcaggacctggccccagtgcgtcgaactgctcccgcacgcccgcgtggtgctgggccactgccgggaccactcggtggtcgacgagaacaccgccaccctgttgcagagcgtgggtgagtacttccgggcgcagggcgaccacaacgaggcggagcggctcctgatggaagccctgcaccagcgggaacgcctcagagaccgctcgcacccgctggtcgccgacaccttgttctgcatcagccggctcaaggtgctgcgcgccgagttgccggaggcgcgggacttcgccgagcgcgccctcgacatccgcacccggctgctcggcgagggggacctccgcacactcgacagccggttgcaactgggcgaggtgctgcgcgaactgggtgacttcgcggcggcgtccgcggtcgtggaacagacgatccggcgcctgcgcagaaggggcgacgccgacccggtgaaggtggccgagagcctgcgcgacctgggtgtcgtccgctggcggcagggacggctcccggagtcgatcggccaccaccgagaggcgctccagttgctcgaacagaccccgggaggcggtgagcgggcccggcgtgacgacaccgcgtcggtgcacgaggcactggggctggccctgctcgactcccgtgatctggaagcggccgaacaccacctgaggaccgcgttggccgtcctcaaggacgcgaagtacgccgagggccaccccctcgtcctgtcctcctccgtccatctcggcgagaccctcaggcaacgggcgatgcggtatcgcgggcgcggcgaccagcgcgccggtgcccgggagcgttcgtccccgggggacctcgaggccgcgcgtctgctgggcgaggcgaagcggaccttcgaccgcgtactgtccgcaccgcatatgaacggggaccatccggaccgcgcctgcgccctcgtccgctacgcgcatctgctgctcgaccagggcaacagcgaagcggccatgacggaggtgacgaacgcgcaccggatctacaccgacaagtacggctcccggcatccctacgtggccgaggcctgctaccgcagggcactcatccacaagaagcggggacagttgcagaaggcgctcgaggatctcgaaacggggcgagagatctatctgggcgtgcaccccgccgatcatcccctgctgcggcaactggacgacgaactccaggatgtctccgccgccgcgaccggagaccatccgtgacacggcgtgccggccctcgtgcagcccgtccactcccttgtccccgctccctgcctccacctagtctgactttgtgccgcaaataaacaaaacctgttcgcccagcgtcgtgccgaacaccgacctcacccggctccgcgtcgccctcaccgtcttcttcgccctggacggcttcgtcttcgccggctgggtcgtccggattccggccatcaaggagcagacgggcgcgtcggcgagcacactcggactcgcgctgctcggagtctcggccggtgcggtgatcaccatgatgctcaccggacgcctctgccgccgcttcggcagccacccggtgacggtggtctgcggcgtcctgctgtcggtgagcgtcgcgctgccgccgttgacgcactccgtaccggccctgggcgcggtgctcctggtcttcggagcggcgtacggcgggatcaacgtggcgttcaacagcgcggccgtcgatctggtgaccgcgctgcacaggcctgtgatgccgagcttccacgccgccttcagcctcggcgggatggtcggcgccgggctcggcggactggtcgccgcccatctgtcccccacccaccatctgctcgccctcaccatggtcggcctgctggtgacggcggtcgcggggcgcaccctgctccgtcacgagcccccggtgccgccggaccgcccgcgacaggaggaacacgcccggcggcctctcgacggccgtacgcgcggactggtcctcgtcttcggcctcatcgcgctctgcacggcgttcggggagggcgcgatggccgactggggcgccctgcacctggagcaggacctggacgcccacccgggcgtcgcggccgccggctactcctgcttcgccctcgccatgacggccggccggctgagcggaacggcactcctcgaacggctgggccggacccgcaccgtggtcgtgggcggcacgaccgccgcggccggcatgctcctcggcgcgctcgccccctcggtgtgggcggcactgctcggcttcgcggtcacggggctcggcctcgcgaacctgttcccggtcgccgtcgaacgcgccggcgcgctggcgggcccgagcggagtcgcgatcgcctccacgctcggatacggcggcatgctcctcgggccgcccgcgatcggcttcatggcggactggtactccctgccggcggcactcacgagcgtggcggcactcgcggcggtggccgcggcgatcggcttcgtgacacggcgtacgacggcagactgacgggcgacgggcagcgggcagcgggcagcgggcagcgggcagcgggcagcgggcagccaggagactttcgcggtcctcgctccccgcgacccctcagggcggcagacggcccgtcacatacagtccgtcacagacggacagccgcagacggtcagccgcactcggccgcgtcgcccgccagcatccgcgtcagcaccgcgcgctgcaccggcagcacctcgtcacgcagggcgcggcccttcggggtgaggcacacctgcacgccgcgccggtcctccgggcacatcccgcgcgtcacgaggccgtccttctccaggcggccgatcagccgggacagggcgctctgactgagatggacgcggtcggcgatctcctgcacgcggtagccgctgccgccgtccggcgcggcaccctcggccagcacgtcgagcacctcgaagtcactggcgcccagaccatgcgggtgcaactcgcggtcgagctcgcacaacgtacgcgcatgcaccgcgagaatcccgcgccactggtcc

(The sequence listing continues in the following parts.)

What is claimed is:

1. A method for identifying a genomic polynucleotide which is concerned with biosynthesis of an antibiotic and is homologous to a gene derived from an actinomycetes, said method comprising:
   (a) incubating a polynucleotide array with a labeled genomic polynucleotide, under hybridization conditions, said polynucleotide array comprising a solid support adhered to at least two of the following groups of polynucleotides (1), (2) and (3): (1) first polynucleotides comprising the nucleotide sequence represented by SEQ ID NO:415, (2) second polynucleotides which are 80% homologous to the first polynucleotides and which encode a polyketide synthase, and (3) third polynucleotides comprising a sequence of 10 to 200 continuous bases of the first or second polynucleotides, wherein at least one polynucleotide on the array is selected from a different group from that of other polynucleotides on the array
   (b) detecting any hybridization of said genomic polynucleotides to said array, and
   (c) determining whether hybridized genomic polynucleotides of step (b) are concerned with biosynthesis of an antibiotic and are homologous to a gene derived from an actinomycetes.

2. The method according to claim 1, wherein the actinomycetes is a microorganism belonging to the genus *Streptomyces*, the genus *Streptosporangium*, the genus *Amycolatop-*

*sis*, the genus *Actinoplanes*, the genus *Nocardioides*, the genus *Pseudonocardia*, the genus *Actinobispora*, the genus *Saccharomonospora*, the genus *Saccharopolyspora*, the genus *Saccharothrix*, the genus *Actinopolyspora*, the genus *Actinomadura*, the genus *Microbispora*, the genus *Microtetraspora*, the genus *Thermomonospora*, or the genus *Micromonospora*.

3. The method according to claim 2, wherein the microorganism belonging to the genus *Streptomyces* is *Streptomyces avermitilis*.

4. The method according to claim 1, wherein the labeled genomic polynucleotide is derived from *Escherichia coli*.

5. The method according to claim 1, wherein said antibiotic is polyketide.

6. The method according to claim 1, wherein said labeled genomic polynucleotide is a labeled actinomycetes genomic polynucleotide.

7. The method according to claim 1, wherein said labeled genomic polynucleotide is a labeled mutant actinomycetes genomic polynucleotide.

* * * * *